United States Patent 12,544,458 (PAH-MODULATING COMPOSITIONS AND METHODS) - sequence listing, part 8

SEQ ID NO: 35487 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttct

SEQ ID NO: 35488 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttct

SEQ ID NO: 35489 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttct

SEQ ID NO: 35490 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttct

SEQ ID NO: 35491 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgccggcccttct

SEQ ID NO: 35492 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttct

SEQ ID NO: 35493 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttct

SEQ ID NO: 35494 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttct

SEQ ID NO: 35495 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttct

SEQ ID NO: 35496 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttct

SEQ ID NO: 35497 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttct

SEQ ID NO: 35498 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttct

SEQ ID NO: 35499 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttct

SEQ ID NO: 35500 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttct

SEQ ID NO: 35501 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttct

SEQ ID NO: 35502 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgctcggcccttct

SEQ ID NO: 35503 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttct

SEQ ID NO: 35504 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttct

SEQ ID NO: 35505 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttct

SEQ ID NO: 35506 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttct

SEQ ID NO: 35507 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttct

SEQ ID NO: 35508 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttct

SEQ ID NO: 35509 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttct

SEQ ID NO: 35510 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttct

SEQ ID NO: 35511 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttct

SEQ ID NO: 35512 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttct

SEQ ID NO: 35513 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgcctcggcccttct

SEQ ID NO: 35514 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttct

SEQ ID NO: 35515 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttct

SEQ ID NO: 35516 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttct

SEQ ID NO: 35517 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttct

SEQ ID NO: 35518 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgccctcggcccttct

SEQ ID NO: 35519 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcacctcggcccttct

SEQ ID NO: 35520 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgctacctcggcccttct

SEQ ID NO: 35521 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcatacctcggcccttct

SEQ ID NO: 35522 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcaatacctcggcccttctc

SEQ ID NO: 35523 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgccaatacctcggcccttctc

SEQ ID NO: 35524 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaatacctcggcccttctc

SEQ ID NO: 35525 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgccacaatacctcggcccttctc

SEQ ID NO: 35526 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaatacctcggcccttctc

SEQ ID NO: 35527 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcgccacaatacctcggcccttctc

SEQ ID NO: 35528 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaatacctcggcccttctc

SEQ ID NO: 35529 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcctgccacaatacctcggcccttctc

SEQ ID NO: 35530 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaatacctcggcccttctc

SEQ ID NO: 35531 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgctgctgccacaatacctcggcccttctc

SEQ ID NO: 35532 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctc

SEQ ID NO: 35533 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctc

SEQ ID NO: 35534 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctc

SEQ ID NO: 35535 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctc

SEQ ID NO: 35536 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctc

SEQ ID NO: 35537 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctc

SEQ ID NO: 35538 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctc

SEQ ID NO: 35539 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctc

SEQ ID NO: 35540 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctc

SEQ ID NO: 35541 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctc

SEQ ID NO: 35542 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgccggcccttctc

SEQ ID NO: 35543 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctc

SEQ ID NO: 35544 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctc

SEQ ID NO: 35545 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctc

SEQ ID NO: 35546 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctc

SEQ ID NO: 35547 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctc

SEQ ID NO: 35548 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctc

SEQ ID NO: 35549 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctc

SEQ ID NO: 35550 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctc

SEQ ID NO: 35551 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctc

SEQ ID NO: 35552 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctc

SEQ ID NO: 35553 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgctcggcccttctc

SEQ ID NO: 35554 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctc

SEQ ID NO: 35555 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctc

SEQ ID NO: 35556 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctc

SEQ ID NO: 35557 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctc

SEQ ID NO: 35558 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctc

SEQ ID NO: 35559 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctc

SEQ ID NO: 35560 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctc

SEQ ID NO: 35561 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctc

SEQ ID NO: 35562 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctc

SEQ ID NO: 35563 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctc

SEQ ID NO: 35564 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgcctcggcccttctc

SEQ ID NO: 35565 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctc

SEQ ID NO: 35566 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctc

SEQ ID NO: 35567 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctc

SEQ ID NO: 35568 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctc

SEQ ID NO: 35569 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgccctcggcccttctc

SEQ ID NO: 35570 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcacctcggcccttctc

SEQ ID NO: 35571 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgctacctcggcccttctc

SEQ ID NO: 35572 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcatacctcggcccttctc

SEQ ID NO: 35573 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcaatacctcggcccttctca

SEQ ID NO: 35574 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgccaatacctcggcccttctca

SEQ ID NO: 35575 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaatacctcggcccttctca

SEQ ID NO: 35576 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgccacaatacctcggcccttctca

SEQ ID NO: 35577 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaatacctcggcccttctca

SEQ ID NO: 35578 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcgccacaatacctcggcccttctca

SEQ ID NO: 35579 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaatacctcggcccttctca

SEQ ID NO: 35580 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcctgccacaatacctcggcccttctca

SEQ ID NO: 35581 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaatacctcggcccttctca

SEQ ID NO: 35582 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgctgctgccacaatacctcggcccttctca

SEQ ID NO: 35583 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctca

SEQ ID NO: 35584 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctca

SEQ ID NO: 35585 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctca

SEQ ID NO: 35586 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctca

SEQ ID NO: 35587 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctca

SEQ ID NO: 35588 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctca

SEQ ID NO: 35589 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctca

SEQ ID NO: 35590 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctca

SEQ ID NO: 35591 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctca

SEQ ID NO: 35592 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctca

SEQ ID NO: 35593 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgccggcccttctca

SEQ ID NO: 35594 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctca

SEQ ID NO: 35595 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctca

SEQ ID NO: 35596 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctca

SEQ ID NO: 35597 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctca

SEQ ID NO: 35598 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctca

SEQ ID NO: 35599 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctca

SEQ ID NO: 35600 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctca

SEQ ID NO: 35601 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctca

SEQ ID NO: 35602 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctca

SEQ ID NO: 35603 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctca

SEQ ID NO: 35604 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgctcggcccttctca

SEQ ID NO: 35605 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctca

SEQ ID NO: 35606 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctca

SEQ ID NO: 35607 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctca

SEQ ID NO: 35608 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctca

SEQ ID NO: 35609 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctca

SEQ ID NO: 35610 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctca

SEQ ID NO: 35611 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctca

SEQ ID NO: 35612 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctca

SEQ ID NO: 35613 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctca

SEQ ID NO: 35614 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctca

SEQ ID NO: 35615 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcctcggcccttctca

SEQ ID NO: 35616 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctca

SEQ ID NO: 35617 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctca

SEQ ID NO: 35618 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctca

SEQ ID NO: 35619 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctca

SEQ ID NO: 35620 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgccctcggcccttctca

SEQ ID NO: 35621 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcacctcggcccttctca

SEQ ID NO: 35622 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgctacctcggcccttctca

SEQ ID NO: 35623 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcatacctcggcccttctca

SEQ ID NO: 35624 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcagggccgagg

SEQ ID NO: 35625 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcaagggccgagg

SEQ ID NO: 35626 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcgaagggccgagg

SEQ ID NO: 35627 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcagaagggccgagg

SEQ ID NO: 35628 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcgagaagggccgagg

SEQ ID NO: 35629 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgctgagaagggccgagg

SEQ ID NO: 35630 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcctgagaagggccgagg

SEQ ID NO: 35631 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcactgagaagggccgagg

SEQ ID NO: 35632 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcaactgagaagggccgagg

SEQ ID NO: 35633 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgaactgagaagggccgagg

SEQ ID NO: 35634 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgccgaactgagaagggccgagg

SEQ ID NO: 35635 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgcgaactgagaagggccgagg

SEQ ID NO: 35636 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcagcgaactgagaagggccgagg

SEQ ID NO: 35637 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgctagcgaactgagaagggccgagg

SEQ ID NO: 35638 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgtagcgaactgagaagggccgagg

SEQ ID NO: 35639 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgccgtagcgaactgagaagggccgagg

SEQ ID NO: 35640 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgctcgtagcgaactgagaagggccgagg

SEQ ID NO: 35641 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgagg

SEQ ID NO: 35642 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgagg

SEQ ID NO: 35643 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgagg

SEQ ID NO: 35644 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgagg

SEQ ID NO: 35645 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgagg

SEQ ID NO: 35646 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgagg

SEQ ID NO: 35647 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgagg

SEQ ID NO: 35648 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgagg

SEQ ID NO: 35649 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgagg

SEQ ID NO: 35650 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgagg

SEQ ID NO: 35651 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgagg

SEQ ID NO: 35652 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgagg

SEQ ID NO: 35653 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgagg

SEQ ID NO: 35654 - DNA, 100 bp, synthetic construct
  source 1..100: mol_type = other DNA
actttgctgccacaatacctgttttagagctagaaatagcaagttaaaataaggctagtccgttatcaacttgaaaaagtggcaccgagtcggtgcgagg

SEQ ID NO: 35655 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgagg

SEQ ID NO: 35656 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgagg

SEQ ID NO: 35657 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgagg

SEQ ID NO: 35658 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgagg

SEQ ID NO: 35659 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgagg

SEQ ID NO: 35660 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgagg

SEQ ID NO: 35661 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgagg

SEQ ID NO: 35662 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgagg

SEQ ID NO: 35663 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgagg

SEQ ID NO: 35664 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgagg

SEQ ID NO: 35665 - DNA, 101 bp, synthetic construct
  source 1..101: mol_type = other DNA
actttgctgccacaatacctgttttagagctagaaatagcaagttaaaataaggctagtccgttatcaacttgaaaaagtggcaccgagtcggtgccgagg

SEQ ID NO: 35666 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgagg

SEQ ID NO: 35667 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgagg

SEQ ID NO: 35668 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgagg

SEQ ID NO: 35669 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgagg

SEQ ID NO: 35670 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgagg

SEQ ID NO: 35671 - DNA, 102 bp, synthetic construct
  source 1..102: mol_type = other DNA
actttgctgccacaatacctgttttagagctagaaatagcaagttaaaataaggctagtccgttatcaacttgaaaaagtggcaccgagtcggtgcccgagg

SEQ ID NO: 35672 - DNA, 103 bp, synthetic construct
  source 1..103: mol_type = other DNA
actttgctgccacaatacctgttttagagctagaaatagcaagttaaaataaggctagtccgttatcaacttgaaaaagtggcaccgagtcggtgcgccgagg

SEQ ID NO: 35673 - DNA, 104 bp, synthetic construct
  source 1..104: mol_type = other DNA
actttgctgccacaatacctgttttagagctagaaatagcaagttaaaataaggctagtccgttatcaacttgaaaaagtggcaccgagtcggtgcggccgagg

SEQ ID NO: 35674 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgcgggccgagg

SEQ ID NO: 35675 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcagggccgaggtattgtggca

SEQ ID NO: 35676 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcaagggccgaggtattgtggca

SEQ ID NO: 35677 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaagggccgaggtattgtggca

SEQ ID NO: 35678 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcagaagggccgaggtattgtggca

SEQ ID NO: 35679 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaagggccgaggtattgtggca

SEQ ID NO: 35680 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgctgagaagggccgaggtattgtggca

SEQ ID NO: 35681 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaagggccgaggtattgtggca

SEQ ID NO: 35682 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcactgagaagggccgaggtattgtggca

SEQ ID NO: 35683 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaagggccgaggtattgtggca

SEQ ID NO: 35684 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggca

SEQ ID NO: 35685 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggca

SEQ ID NO: 35686 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggca

SEQ ID NO: 35687 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggca

SEQ ID NO: 35688 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggca

SEQ ID NO: 35689 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggca

SEQ ID NO: 35690 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggca

SEQ ID NO: 35691 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggca

SEQ ID NO: 35692 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggca

SEQ ID NO: 35693 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggca

SEQ ID NO: 35694 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggca

SEQ ID NO: 35695 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggca

SEQ ID NO: 35696 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggca

SEQ ID NO: 35697 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggca

SEQ ID NO: 35698 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggca

SEQ ID NO: 35699 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggca

SEQ ID NO: 35700 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggca

SEQ ID NO: 35701 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggca

SEQ ID NO: 35702 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggca

SEQ ID NO: 35703 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggca

SEQ ID NO: 35704 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggca

SEQ ID NO: 35705 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcgaggtattgtggca

SEQ ID NO: 35706 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggca

SEQ ID NO: 35707 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggca

SEQ ID NO: 35708 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggca

SEQ ID NO: 35709 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggca

SEQ ID NO: 35710 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggca

SEQ ID NO: 35711 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggca

SEQ ID NO: 35712 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggca

SEQ ID NO: 35713 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggca

SEQ ID NO: 35714 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggca

SEQ ID NO: 35715 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggca

SEQ ID NO: 35716 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgccgaggtattgtggca

SEQ ID NO: 35717 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggca

SEQ ID NO: 35718 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggca

SEQ ID NO: 35719 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggca

SEQ ID NO: 35720 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggca

SEQ ID NO: 35721 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggca

SEQ ID NO: 35722 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcccgaggtattgtggca

SEQ ID NO: 35723 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgccgaggtattgtggca

SEQ ID NO: 35724 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcggccgaggtattgtggca

SEQ ID NO: 35725 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgggccgaggtattgtggca

SEQ ID NO: 35726 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcagggccgaggtattgtggcag

SEQ ID NO: 35727 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcaagggccgaggtattgtggcag

SEQ ID NO: 35728 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaagggccgaggtattgtggcag

SEQ ID NO: 35729 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcagaagggccgaggtattgtggcag

SEQ ID NO: 35730 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaagggccgaggtattgtggcag

SEQ ID NO: 35731 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgctgagaagggccgaggtattgtggcag

SEQ ID NO: 35732 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaagggccgaggtattgtggcag

SEQ ID NO: 35733 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcactgagaagggccgaggtattgtggcag

SEQ ID NO: 35734 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcag

SEQ ID NO: 35735 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcag

SEQ ID NO: 35736 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcag

SEQ ID NO: 35737 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcag

SEQ ID NO: 35738 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcag

SEQ ID NO: 35739 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcag

SEQ ID NO: 35740 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcag

SEQ ID NO: 35741 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcag

SEQ ID NO: 35742 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcag

SEQ ID NO: 35743 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcag

SEQ ID NO: 35744 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcag

SEQ ID NO: 35745 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcag

SEQ ID NO: 35746 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcag

SEQ ID NO: 35747 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcag

SEQ ID NO: 35748 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcag

SEQ ID NO: 35749 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcag

SEQ ID NO: 35750 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcag

SEQ ID NO: 35751 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcag

SEQ ID NO: 35752 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcag

SEQ ID NO: 35753 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcag

SEQ ID NO: 35754 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcag

SEQ ID NO: 35755 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcag

SEQ ID NO: 35756 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcgaggtattgtggcag

SEQ ID NO: 35757 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcag

SEQ ID NO: 35758 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcag

SEQ ID NO: 35759 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcag

SEQ ID NO: 35760 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcag

SEQ ID NO: 35761 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcag

SEQ ID NO: 35762 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcag

SEQ ID NO: 35763 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcag

SEQ ID NO: 35764 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcag

SEQ ID NO: 35765 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcag

SEQ ID NO: 35766 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcag

SEQ ID NO: 35767 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgccgaggtattgtggcag

SEQ ID NO: 35768 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcag

SEQ ID NO: 35769 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcag

SEQ ID NO: 35770 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcag

SEQ ID NO: 35771 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcag

SEQ ID NO: 35772 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcag

SEQ ID NO: 35773 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcccgaggtattgtggcag

SEQ ID NO: 35774 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgccgaggtattgtggcag

SEQ ID NO: 35775 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcggccgaggtattgtggcag

SEQ ID NO: 35776 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgggccgaggtattgtggcag

SEQ ID NO: 35777 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcagggccgaggtattgtggcagc

SEQ ID NO: 35778 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcaagggccgaggtattgtggcagc

SEQ ID NO: 35779 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgaagggccgaggtattgtggcagc

SEQ ID NO: 35780 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcagaagggccgaggtattgtggcagc

SEQ ID NO: 35781 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgagaagggccgaggtattgtggcagc

SEQ ID NO: 35782 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgctgagaagggccgaggtattgtggcagc

SEQ ID NO: 35783 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagc

SEQ ID NO: 35784 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagc

SEQ ID NO: 35785 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagc

SEQ ID NO: 35786 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagc

SEQ ID NO: 35787 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagc

SEQ ID NO: 35788 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagc

SEQ ID NO: 35789 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagc

SEQ ID NO: 35790 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagc

SEQ ID NO: 35791 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagc

SEQ ID NO: 35792 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagc

SEQ ID NO: 35793 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagc

SEQ ID NO: 35794 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagc

SEQ ID NO: 35795 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagc

SEQ ID NO: 35796 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagc

SEQ ID NO: 35797 - DNA, 138 bp, synthetic construct; identical to SEQ ID NO: 29034
  source 1..138: mol_type = other DNA

SEQ ID NO: 35798 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagc

SEQ ID NO: 35799 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagc

SEQ ID NO: 35800 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagc

SEQ ID NO: 35801 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagc

SEQ ID NO: 35802 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagc

SEQ ID NO: 35803 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagc

SEQ ID NO: 35804 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagc

SEQ ID NO: 35805 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagc

SEQ ID NO: 35806 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagc

SEQ ID NO: 35807 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgaggtattgtggcagc

SEQ ID NO: 35808 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagc

SEQ ID NO: 35809 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagc

SEQ ID NO: 35810 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagc

SEQ ID NO: 35811 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagc

SEQ ID NO: 35812 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagc

SEQ ID NO: 35813 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagc

SEQ ID NO: 35814 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagc

SEQ ID NO: 35815 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagc

SEQ ID NO: 35816 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagc

SEQ ID NO: 35817 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagc

SEQ ID NO: 35818 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgccgaggtattgtggcagc

SEQ ID NO: 35819 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagc

SEQ ID NO: 35820 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagc

SEQ ID NO: 35821 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagc

SEQ ID NO: 35822 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagc

SEQ ID NO: 35823 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagc

SEQ ID NO: 35824 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcccgaggtattgtggcagc

SEQ ID NO: 35825 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgccgaggtattgtggcagc

SEQ ID NO: 35826 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcggccgaggtattgtggcagc

SEQ ID NO: 35827 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgggccgaggtattgtggcagc

SEQ ID NO: 35828 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcagggccgaggtattgtggcagca

SEQ ID NO: 35829 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcaagggccgaggtattgtggcagca

SEQ ID NO: 35830 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgaagggccgaggtattgtggcagca

SEQ ID NO: 35831 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcagaagggccgaggtattgtggcagca

SEQ ID NO: 35832 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgagaagggccgaggtattgtggcagca

SEQ ID NO: 35833 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgctgagaagggccgaggtattgtggcagca

SEQ ID NO: 35834 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagca

SEQ ID NO: 35835 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagca

SEQ ID NO: 35836 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagca

SEQ ID NO: 35837 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagca

SEQ ID NO: 35838 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagca

SEQ ID NO: 35839 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagca

SEQ ID NO: 35840 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagca

SEQ ID NO: 35841 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagca

SEQ ID NO: 35842 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagca

SEQ ID NO: 35843 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagca

SEQ ID NO: 35844 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagca

SEQ ID NO: 35845 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagca

SEQ ID NO: 35846 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagca

SEQ ID NO: 35847 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagca

SEQ ID NO: 35848 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagca

SEQ ID NO: 35849 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagca

SEQ ID NO: 35850 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagca

SEQ ID NO: 35851 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagca

SEQ ID NO: 35852 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagca

SEQ ID NO: 35853 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagca

SEQ ID NO: 35854 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagca

SEQ ID NO: 35855 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagca

SEQ ID NO: 35856 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagca

SEQ ID NO: 35857 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagca

SEQ ID NO: 35858 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgaggtattgtggcagca

SEQ ID NO: 35859 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagca

SEQ ID NO: 35860 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagca

SEQ ID NO: 35861 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagca

SEQ ID NO: 35862 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagca

SEQ ID NO: 35863 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagca

SEQ ID NO: 35864 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagca

SEQ ID NO: 35865 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagca

SEQ ID NO: 35866 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagca

SEQ ID NO: 35867 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagca

SEQ ID NO: 35868 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagca

SEQ ID NO: 35869 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgccgaggtattgtggcagca

SEQ ID NO: 35870 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagca

SEQ ID NO: 35871 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagca

SEQ ID NO: 35872 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagca

SEQ ID NO: 35873 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagca

SEQ ID NO: 35874 - DNA, 163 bp, synthetic construct
  source 1..163: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagca

SEQ ID NO: 35875 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcccgaggtattgtggcagca

SEQ ID NO: 35876 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgccgaggtattgtggcagca

SEQ ID NO: 35877 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcggccgaggtattgtggcagca

SEQ ID NO: 35878 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgggccgaggtattgtggcagca

SEQ ID NO: 35879 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcagggccgaggtattgtggcagcaa

SEQ ID NO: 35880 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcaagggccgaggtattgtggcagcaa

SEQ ID NO: 35881 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgaagggccgaggtattgtggcagcaa

SEQ ID NO: 35882 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcagaagggccgaggtattgtggcagcaa

SEQ ID NO: 35883 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgagaagggccgaggtattgtggcagcaa

SEQ ID NO: 35884 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgctgagaagggccgaggtattgtggcagcaa

SEQ ID NO: 35885 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagcaa

SEQ ID NO: 35886 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagcaa

SEQ ID NO: 35887 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagcaa

SEQ ID NO: 35888 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagcaa

SEQ ID NO: 35889 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagcaa

SEQ ID NO: 35890 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagcaa

SEQ ID NO: 35891 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagcaa

SEQ ID NO: 35892 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagcaa

SEQ ID NO: 35893 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagcaa

SEQ ID NO: 35894 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagcaa

SEQ ID NO: 35895 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagcaa

SEQ ID NO: 35896 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagcaa

SEQ ID NO: 35897 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagcaa

SEQ ID NO: 35898 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagcaa

SEQ ID NO: 35899 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagcaa

SEQ ID NO: 35900 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagcaa

SEQ ID NO: 35901 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagcaa

SEQ ID NO: 35902 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagcaa

SEQ ID NO: 35903 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagcaa

SEQ ID NO: 35904 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagcaa

SEQ ID NO: 35905 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagcaa

SEQ ID NO: 35906 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagcaa

SEQ ID NO: 35907 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagcaa

SEQ ID NO: 35908 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagcaa

SEQ ID NO: 35909 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgaggtattgtggcagcaa

SEQ ID NO: 35910 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagcaa

SEQ ID NO: 35911 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagcaa

SEQ ID NO: 35912 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagcaa

SEQ ID NO: 35913 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagcaa

SEQ ID NO: 35914 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagcaa

SEQ ID NO: 35915 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagcaa

SEQ ID NO: 35916 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagcaa

SEQ ID NO: 35917 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagcaa

SEQ ID NO: 35918 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagcaa

SEQ ID NO: 35919 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagcaa

SEQ ID NO: 35920 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgccgaggtattgtggcagcaa

SEQ ID NO: 35921 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagcaa

SEQ ID NO: 35922 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagcaa

SEQ ID NO: 35923 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagcaa

SEQ ID NO: 35924 - DNA, 163 bp, synthetic construct
  source 1..163: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagcaa

SEQ ID NO: 35925 - DNA, 164 bp, synthetic construct
  source 1..164: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagcaa

SEQ ID NO: 35926 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcccgaggtattgtggcagcaa

SEQ ID NO: 35927 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgccgaggtattgtggcagcaa

SEQ ID NO: 35928 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcggccgaggtattgtggcagcaa

SEQ ID NO: 35929 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgggccgaggtattgtggcagcaa

SEQ ID NO: 35930 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcagggccgaggtattgtggcagcaaa

SEQ ID NO: 35931 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcaagggccgaggtattgtggcagcaaa

SEQ ID NO: 35932 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgaagggccgaggtattgtggcagcaaa

SEQ ID NO: 35933 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcagaagggccgaggtattgtggcagcaaa

SEQ ID NO: 35934 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgagaagggccgaggtattgtggcagcaaa

SEQ ID NO: 35935 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctgagaagggccgaggtattgtggcagcaaa

SEQ ID NO: 35936 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagcaaa

SEQ ID NO: 35937 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagcaaa

SEQ ID NO: 35938 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagcaaa

SEQ ID NO: 35939 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagcaaa

SEQ ID NO: 35940 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagcaaa

SEQ ID NO: 35941 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagcaaa

SEQ ID NO: 35942 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagcaaa

SEQ ID NO: 35943 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagcaaa

SEQ ID NO: 35944 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagcaaa

SEQ ID NO: 35945 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagcaaa

SEQ ID NO: 35946 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagcaaa

SEQ ID NO: 35947 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagcaaa

SEQ ID NO: 35948 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagcaaa

SEQ ID NO: 35949 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagcaaa

SEQ ID NO: 35950 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagcaaa

SEQ ID NO: 35951 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagcaaa

SEQ ID NO: 35952 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagcaaa

SEQ ID NO: 35953 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagcaaa

SEQ ID NO: 35954 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagcaaa

SEQ ID NO: 35955 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagcaaa

SEQ ID NO: 35956 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagcaaa

SEQ ID NO: 35957 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagcaaa

SEQ ID NO: 35958 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagcaaa

SEQ ID NO: 35959 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagcaaa

SEQ ID NO: 35960 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgaggtattgtggcagcaaa

SEQ ID NO: 35961 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagcaaa

SEQ ID NO: 35962 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagcaaa

SEQ ID NO: 35963 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagcaaa

SEQ ID NO: 35964 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagcaaa

SEQ ID NO: 35965 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagcaaa

SEQ ID NO: 35966 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagcaaa

SEQ ID NO: 35967 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagcaaa

SEQ ID NO: 35968 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagcaaa

SEQ ID NO: 35969 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagcaaa

SEQ ID NO: 35970 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagcaaa

SEQ ID NO: 35971 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgccgaggtattgtggcagcaaa

SEQ ID NO: 35972 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagcaaa

SEQ ID NO: 35973 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagcaaa

SEQ ID NO: 35974 - DNA, 163 bp, synthetic construct
  source 1..163: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagcaaa

SEQ ID NO: 35975 - DNA, 164 bp, synthetic construct
  source 1..164: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagcaaa

SEQ ID NO: 35976 - DNA, 165 bp, synthetic construct
  source 1..165: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagcaaa

SEQ ID NO: 35977 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcccgaggtattgtggcagcaaa

SEQ ID NO: 35978 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgccgaggtattgtggcagcaaa

SEQ ID NO: 35979 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcggccgaggtattgtggcagcaaa

SEQ ID NO: 35980 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgggccgaggtattgtggcagcaaa

SEQ ID NO: 35981 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcagggccgaggtattgtggcagcaaag

SEQ ID NO: 35982 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaagggccgaggtattgtggcagcaaag

SEQ ID NO: 35983 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgaagggccgaggtattgtggcagcaaag

SEQ ID NO: 35984 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcagaagggccgaggtattgtggcagcaaag

SEQ ID NO: 35985 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgagaagggccgaggtattgtggcagcaaag

SEQ ID NO: 35986 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctgagaagggccgaggtattgtggcagcaaag

SEQ ID NO: 35987 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagcaaag

SEQ ID NO: 35988 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagcaaag

SEQ ID NO: 35989 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagcaaag

SEQ ID NO: 35990 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagcaaag

SEQ ID NO: 35991 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagcaaag

SEQ ID NO: 35992 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagcaaag

SEQ ID NO: 35993 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagcaaag

SEQ ID NO: 35994 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagcaaag

SEQ ID NO: 35995 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagcaaag

SEQ ID NO: 35996 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagcaaag

SEQ ID NO: 35997 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagcaaag

SEQ ID NO: 35998 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagcaaag

SEQ ID NO: 35999 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagcaaag

SEQ ID NO: 36000 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagcaaag

SEQ ID NO: 36001 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagcaaag

SEQ ID NO: 36002 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagcaaag

SEQ ID NO: 36003 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagcaaag

SEQ ID NO: 36004 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagcaaag

SEQ ID NO: 36005 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagcaaag

SEQ ID NO: 36006 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagcaaag

SEQ ID NO: 36007 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagcaaag

SEQ ID NO: 36008 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagcaaag

SEQ ID NO: 36009 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagcaaag

SEQ ID NO: 36010 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagcaaag

SEQ ID NO: 36011 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgaggtattgtggcagcaaag

SEQ ID NO: 36012 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagcaaag

SEQ ID NO: 36013 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagcaaag

SEQ ID NO: 36014 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagcaaag

SEQ ID NO: 36015 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagcaaag

SEQ ID NO: 36016 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagcaaag

SEQ ID NO: 36017 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagcaaag

SEQ ID NO: 36018 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagcaaag

SEQ ID NO: 36019 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagcaaag

SEQ ID NO: 36020 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagcaaag

SEQ ID NO: 36021 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagcaaag

SEQ ID NO: 36022 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgccgaggtattgtggcagcaaag

SEQ ID NO: 36023 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagcaaag

SEQ ID NO: 36024 - DNA, 163 bp, synthetic construct
  source 1..163: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagcaaag

SEQ ID NO: 36025 - DNA, 164 bp, synthetic construct
  source 1..164: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagcaaag

SEQ ID NO: 36026 - DNA, 165 bp, synthetic construct
  source 1..165: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagcaaag

SEQ ID NO: 36027 - DNA, 166 bp, synthetic construct
  source 1..166: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagcaaag

SEQ ID NO: 36028 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcccgaggtattgtggcagcaaag

SEQ ID NO: 36029 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgccgaggtattgtggcagcaaag

SEQ ID NO: 36030 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcggccgaggtattgtggcagcaaag

SEQ ID NO: 36031 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgggccgaggtattgtggcagcaaag

SEQ ID NO: 36032 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcagggccgaggtattgtggcagcaaagt

SEQ ID NO: 36033 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaagggccgaggtattgtggcagcaaagt

SEQ ID NO: 36034 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgaagggccgaggtattgtggcagcaaagt

SEQ ID NO: 36035 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcagaagggccgaggtattgtggcagcaaagt

SEQ ID NO: 36036 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgagaagggccgaggtattgtggcagcaaagt

SEQ ID NO: 36037 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctgagaagggccgaggtattgtggcagcaaagt

SEQ ID NO: 36038 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcctgagaagggccgaggtattgtggcagcaaagt

SEQ ID NO: 36039 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcactgagaagggccgaggtattgtggcagcaaagt

SEQ ID NO: 36040 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcaactgagaagggccgaggtattgtggcagcaaagt

SEQ ID NO: 36041 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggcagcaaagt

SEQ ID NO: 36042 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggcagcaaagt

SEQ ID NO: 36043 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggcagcaaagt

SEQ ID NO: 36044 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggcagcaaagt

SEQ ID NO: 36045 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggcagcaaagt

SEQ ID NO: 36046 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggcagcaaagt

SEQ ID NO: 36047 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggcagcaaagt

SEQ ID NO: 36048 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggcagcaaagt

SEQ ID NO: 36049 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggcagcaaagt

SEQ ID NO: 36050 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggcagcaaagt

SEQ ID NO: 36051 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggcagcaaagt

SEQ ID NO: 36052 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagcaaagt

SEQ ID NO: 36053 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggcagcaaagt

SEQ ID NO: 36054 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggcagcaaagt

SEQ ID NO: 36055 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggcagcaaagt

SEQ ID NO: 36056 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggcagcaaagt

SEQ ID NO: 36057 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggcagcaaagt

SEQ ID NO: 36058 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggcagcaaagt

SEQ ID NO: 36059 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggcagcaaagt

SEQ ID NO: 36060 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggcagcaaagt

SEQ ID NO: 36061 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggcagcaaagt

SEQ ID NO: 36062 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaggtattgtggcagcaaagt

SEQ ID NO: 36063 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggcagcaaagt

SEQ ID NO: 36064 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggcagcaaagt

SEQ ID NO: 36065 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggcagcaaagt

SEQ ID NO: 36066 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggcagcaaagt

SEQ ID NO: 36067 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggcagcaaagt

SEQ ID NO: 36068 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggcagcaaagt

SEQ ID NO: 36069 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggcagcaaagt

SEQ ID NO: 36070 - DNA, 160 bp, synthetic construct
  source 1..160: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggcagcaaagt

SEQ ID NO: 36071 - DNA, 161 bp, synthetic construct
  source 1..161: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggcagcaaagt

SEQ ID NO: 36072 - DNA, 162 bp, synthetic construct
  source 1..162: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggcagcaaagt

SEQ ID NO: 36073 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgccgaggtattgtggcagcaaagt

SEQ ID NO: 36074 - DNA, 163 bp, synthetic construct
  source 1..163: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggcagcaaagt

SEQ ID NO: 36075 - DNA, 164 bp, synthetic construct
  source 1..164: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggcagcaaagt

SEQ ID NO: 36076 - DNA, 165 bp, synthetic construct
  source 1..165: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggcagcaaagt

SEQ ID NO: 36077 - DNA, 166 bp, synthetic construct
  source 1..166: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggcagcaaagt

SEQ ID NO: 36078 - DNA, 167 bp, synthetic construct
  source 1..167: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggcagcaaagt

SEQ ID NO: 36079 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcccgaggtattgtggcagcaaagt

SEQ ID NO: 36080 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgccgaggtattgtggcagcaaagt

SEQ ID NO: 36081 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcggccgaggtattgtggcagcaaagt

SEQ ID NO: 36082 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgggccgaggtattgtggcagcaaagt

SEQ ID NO: 36083 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcagggccgaggt

SEQ ID NO: 36084 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcaagggccgaggt

SEQ ID NO: 36085 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcgaagggccgaggt

SEQ ID NO: 36086 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcagaagggccgaggt

SEQ ID NO: 36087 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcgagaagggccgaggt

SEQ ID NO: 36088 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgctgagaagggccgaggt

SEQ ID NO: 36089 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcctgagaagggccgaggt

SEQ ID NO: 36090 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcactgagaagggccgaggt

SEQ ID NO: 36091 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcaactgagaagggccgaggt

SEQ ID NO: 36092 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgaactgagaagggccgaggt

SEQ ID NO: 36093 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgccgaactgagaagggccgaggt

SEQ ID NO: 36094 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgcgaactgagaagggccgaggt

SEQ ID NO: 36095 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcagcgaactgagaagggccgaggt

SEQ ID NO: 36096 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgctagcgaactgagaagggccgaggt

SEQ ID NO: 36097 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgtagcgaactgagaagggccgaggt

SEQ ID NO: 36098 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgccgtagcgaactgagaagggccgaggt

SEQ ID NO: 36099 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggt

SEQ ID NO: 36100 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggt

SEQ ID NO: 36101 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggt

SEQ ID NO: 36102 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggt

SEQ ID NO: 36103 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggt

SEQ ID NO: 36104 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggt

SEQ ID NO: 36105 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggt

SEQ ID NO: 36106 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggt

SEQ ID NO: 36107 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggt

SEQ ID NO: 36108 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggt

SEQ ID NO: 36109 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggt

SEQ ID NO: 36110 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggt

SEQ ID NO: 36111 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggt

SEQ ID NO: 36112 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggt

SEQ ID NO: 36113 - DNA, 101 bp, synthetic construct
  source 1..101: mol_type = other DNA
actttgctgccacaatacctgttttagagctagaaatagcaagttaaaataaggctagtccgttatcaacttgaaaaagtggcaccgagtcggtgcgaggt

SEQ ID NO: 36114 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggt

SEQ ID NO: 36115 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggt

SEQ ID NO: 36116 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggt

SEQ ID NO: 36117 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggt

SEQ ID NO: 36118 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggt

SEQ ID NO: 36119 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggt

SEQ ID NO: 36120 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggt

SEQ ID NO: 36121 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggt

SEQ ID NO: 36122 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggt

SEQ ID NO: 36123 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggt

SEQ ID NO: 36124 - DNA, 102 bp, synthetic construct
  source 1..102: mol_type = other DNA
actttgctgccacaatacctgttttagagctagaaatagcaagttaaaataaggctagtccgttatcaacttgaaaaagtggcaccgagtcggtgccgaggt

SEQ ID NO: 36125 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggt

SEQ ID NO: 36126 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggt

SEQ ID NO: 36127 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggt

SEQ ID NO: 36128 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggt

SEQ ID NO: 36129 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggt

SEQ ID NO: 36130 - DNA, 103 bp, synthetic construct
  source 1..103: mol_type = other DNA
actttgctgccacaatacctgttttagagctagaaatagcaagttaaaataaggctagtccgttatcaacttgaaaaagtggcaccgagtcggtgcccgaggt

SEQ ID NO: 36131 - DNA, 104 bp, synthetic construct
  source 1..104: mol_type = other DNA
actttgctgccacaatacctgttttagagctagaaatagcaagttaaaataaggctagtccgttatcaacttgaaaaagtggcaccgagtcggtgcgccgaggt

SEQ ID NO: 36132 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgcggccgaggt

SEQ ID NO: 36133 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcgggccgaggt

SEQ ID NO: 36134 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcagggccgaggta

SEQ ID NO: 36135 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcaagggccgaggta

SEQ ID NO: 36136 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcgaagggccgaggta

SEQ ID NO: 36137 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcagaagggccgaggta

SEQ ID NO: 36138 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgagaagggccgaggta

SEQ ID NO: 36139 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgctgagaagggccgaggta

SEQ ID NO: 36140 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcctgagaagggccgaggta

SEQ ID NO: 36141 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcactgagaagggccgaggta

SEQ ID NO: 36142 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcaactgagaagggccgaggta

SEQ ID NO: 36143 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaactgagaagggccgaggta

SEQ ID NO: 36144 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgccgaactgagaagggccgaggta

SEQ ID NO: 36145 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgcgaactgagaagggccgaggta

SEQ ID NO: 36146 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcagcgaactgagaagggccgaggta

SEQ ID NO: 36147 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgctagcgaactgagaagggccgaggta

SEQ ID NO: 36148 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgtagcgaactgagaagggccgaggta

SEQ ID NO: 36149 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgccgtagcgaactgagaagggccgaggta

SEQ ID NO: 36150 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggta

SEQ ID NO: 36151 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggta

SEQ ID NO: 36152 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggta

SEQ ID NO: 36153 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggta

SEQ ID NO: 36154 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggta

SEQ ID NO: 36155 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggta

SEQ ID NO: 36156 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggta

SEQ ID NO: 36157 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggta

SEQ ID NO: 36158 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggta

SEQ ID NO: 36159 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggta

SEQ ID NO: 36160 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggta

SEQ ID NO: 36161 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggta

SEQ ID NO: 36162 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggta

SEQ ID NO: 36163 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggta

SEQ ID NO: 36164 - DNA, 102 bp, synthetic construct
  source 1..102: mol_type = other DNA
actttgctgccacaatacctgttttagagctagaaatagcaagttaaaataaggctagtccgttatcaacttgaaaaagtggcaccgagtcggtgcgaggta

SEQ ID NO: 36165 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggta

SEQ ID NO: 36166 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggta

SEQ ID NO: 36167 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggta

SEQ ID NO: 36168 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggta

SEQ ID NO: 36169 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggta

SEQ ID NO: 36170 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggta

SEQ ID NO: 36171 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggta

SEQ ID NO: 36172 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggta

SEQ ID NO: 36173 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggta

SEQ ID NO: 36174 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggta

SEQ ID NO: 36175 - DNA, 103 bp, synthetic construct
  source 1..103: mol_type = other DNA
actttgctgccacaatacctgttttagagctagaaatagcaagttaaaataaggctagtccgttatcaacttgaaaaagtggcaccgagtcggtgccgaggta

SEQ ID NO: 36176 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggta

SEQ ID NO: 36177 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggta

SEQ ID NO: 36178 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggta

SEQ ID NO: 36179 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggta

SEQ ID NO: 36180 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggta

SEQ ID NO: 36181 - DNA, 104 bp, synthetic construct
  source 1..104: mol_type = other DNA
actttgctgccacaatacctgttttagagctagaaatagcaagttaaaataaggctagtccgttatcaacttgaaaaagtggcaccgagtcggtgcccgaggta

SEQ ID NO: 36182 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgcgccgaggta

SEQ ID NO: 36183 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcggccgaggta

SEQ ID NO: 36184 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcgggccgaggta

SEQ ID NO: 36185 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcagggccgaggtat

SEQ ID NO: 36186 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcaagggccgaggtat

SEQ ID NO: 36187 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcgaagggccgaggtat

SEQ ID NO: 36188 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcagaagggccgaggtat

SEQ ID NO: 36189 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgagaagggccgaggtat

SEQ ID NO: 36190 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgctgagaagggccgaggtat

SEQ ID NO: 36191 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcctgagaagggccgaggtat

SEQ ID NO: 36192 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcactgagaagggccgaggtat

SEQ ID NO: 36193 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcaactgagaagggccgaggtat

SEQ ID NO: 36194 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaactgagaagggccgaggtat

SEQ ID NO: 36195 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgccgaactgagaagggccgaggtat

SEQ ID NO: 36196 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgcgaactgagaagggccgaggtat

SEQ ID NO: 36197 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcagcgaactgagaagggccgaggtat

SEQ ID NO: 36198 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgctagcgaactgagaagggccgaggtat

SEQ ID NO: 36199 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtat

SEQ ID NO: 36200 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtat

SEQ ID NO: 36201 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtat

SEQ ID NO: 36202 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtat

SEQ ID NO: 36203 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtat

SEQ ID NO: 36204 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtat

SEQ ID NO: 36205 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtat

SEQ ID NO: 36206 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtat

SEQ ID NO: 36207 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtat

SEQ ID NO: 36208 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtat

SEQ ID NO: 36209 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtat

SEQ ID NO: 36210 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtat

SEQ ID NO: 36211 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtat

SEQ ID NO: 36212 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtat

SEQ ID NO: 36213 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtat

SEQ ID NO: 36214 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtat

SEQ ID NO: 36215 - DNA, 103 bp, synthetic construct
  source 1..103: mol_type = other DNA
actttgctgccacaatacctgttttagagctagaaatagcaagttaaaataaggctagtccgttatcaacttgaaaaagtggcaccgagtcggtgcgaggtat

SEQ ID NO: 36216 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtat

SEQ ID NO: 36217 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtat

SEQ ID NO: 36218 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtat

SEQ ID NO: 36219 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtat

SEQ ID NO: 36220 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtat

SEQ ID NO: 36221 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtat

SEQ ID NO: 36222 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtat

SEQ ID NO: 36223 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtat

SEQ ID NO: 36224 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtat

SEQ ID NO: 36225 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtat

SEQ ID NO: 36226 - DNA, 104 bp, synthetic construct
  source 1..104: mol_type = other DNA
actttgctgccacaatacctgttttagagctagaaatagcaagttaaaataaggctagtccgttatcaacttgaaaaagtggcaccgagtcggtgccgaggtat

SEQ ID NO: 36227 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtat

SEQ ID NO: 36228 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtat

SEQ ID NO: 36229 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtat

SEQ ID NO: 36230 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtat

SEQ ID NO: 36231 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtat

SEQ ID NO: 36232 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgcccgaggtat

SEQ ID NO: 36233 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcgccgaggtat

SEQ ID NO: 36234 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcggccgaggtat

SEQ ID NO: 36235 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcgggccgaggtat

SEQ ID NO: 36236 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcagggccgaggtatt

SEQ ID NO: 36237 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcaagggccgaggtatt

SEQ ID NO: 36238 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgaagggccgaggtatt

SEQ ID NO: 36239 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcagaagggccgaggtatt

SEQ ID NO: 36240 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgagaagggccgaggtatt

SEQ ID NO: 36241 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgctgagaagggccgaggtatt

SEQ ID NO: 36242 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcctgagaagggccgaggtatt

SEQ ID NO: 36243 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcactgagaagggccgaggtatt

SEQ ID NO: 36244 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcaactgagaagggccgaggtatt

SEQ ID NO: 36245 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaactgagaagggccgaggtatt

SEQ ID NO: 36246 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgccgaactgagaagggccgaggtatt

SEQ ID NO: 36247 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgcgaactgagaagggccgaggtatt

SEQ ID NO: 36248 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcagcgaactgagaagggccgaggtatt

SEQ ID NO: 36249 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgctagcgaactgagaagggccgaggtatt

SEQ ID NO: 36250 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtatt

SEQ ID NO: 36251 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtatt

SEQ ID NO: 36252 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtatt

SEQ ID NO: 36253 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtatt

SEQ ID NO: 36254 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtatt

SEQ ID NO: 36255 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtatt

SEQ ID NO: 36256 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtatt

SEQ ID NO: 36257 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtatt

SEQ ID NO: 36258 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtatt

SEQ ID NO: 36259 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtatt

SEQ ID NO: 36260 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtatt

SEQ ID NO: 36261 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtatt

SEQ ID NO: 36262 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtatt

SEQ ID NO: 36263 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtatt

SEQ ID NO: 36264 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtatt

SEQ ID NO: 36265 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtatt

SEQ ID NO: 36266 - DNA, 104 bp, synthetic construct
  source 1..104: mol_type = other DNA
actttgctgccacaatacctgttttagagctagaaatagcaagttaaaataaggctagtccgttatcaacttgaaaaagtggcaccgagtcggtgcgaggtatt

SEQ ID NO: 36267 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtatt

SEQ ID NO: 36268 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtatt

SEQ ID NO: 36269 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtatt

SEQ ID NO: 36270 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtatt

SEQ ID NO: 36271 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtatt

SEQ ID NO: 36272 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtatt

SEQ ID NO: 36273 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtatt

SEQ ID NO: 36274 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtatt

SEQ ID NO: 36275 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtatt

SEQ ID NO: 36276 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtatt

SEQ ID NO: 36277 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgccgaggtatt

SEQ ID NO: 36278 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtatt

SEQ ID NO: 36279 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtatt

SEQ ID NO: 36280 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtatt

SEQ ID NO: 36281 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtatt

SEQ ID NO: 36282 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtatt

SEQ ID NO: 36283 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcccgaggtatt

SEQ ID NO: 36284 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcgccgaggtatt

SEQ ID NO: 36285 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcggccgaggtatt

SEQ ID NO: 36286 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcgggccgaggtatt

SEQ ID NO: 36287 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcagggccgaggtattg

SEQ ID NO: 36288 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcaagggccgaggtattg

SEQ ID NO: 36289 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgaagggccgaggtattg

SEQ ID NO: 36290 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcagaagggccgaggtattg

SEQ ID NO: 36291 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgagaagggccgaggtattg

SEQ ID NO: 36292 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgctgagaagggccgaggtattg

SEQ ID NO: 36293 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcctgagaagggccgaggtattg

SEQ ID NO: 36294 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcactgagaagggccgaggtattg

SEQ ID NO: 36295 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcaactgagaagggccgaggtattg

SEQ ID NO: 36296 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgaactgagaagggccgaggtattg

SEQ ID NO: 36297 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgccgaactgagaagggccgaggtattg

SEQ ID NO: 36298 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgcgaactgagaagggccgaggtattg

SEQ ID NO: 36299 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcagcgaactgagaagggccgaggtattg

SEQ ID NO: 36300 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgctagcgaactgagaagggccgaggtattg

SEQ ID NO: 36301 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattg

SEQ ID NO: 36302 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattg

SEQ ID NO: 36303 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattg

SEQ ID NO: 36304 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattg

SEQ ID NO: 36305 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattg

SEQ ID NO: 36306 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattg

SEQ ID NO: 36307 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattg

SEQ ID NO: 36308 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattg

SEQ ID NO: 36309 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattg

SEQ ID NO: 36310 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattg

SEQ ID NO: 36311 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattg

SEQ ID NO: 36312 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattg

SEQ ID NO: 36313 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattg

SEQ ID NO: 36314 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattg

SEQ ID NO: 36315 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattg

SEQ ID NO: 36316 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattg

SEQ ID NO: 36317 - DNA, 105 bp, synthetic construct
  source 1..105: mol_type = other DNA
actttgctgccacaatacctgttttagagctagaaatagcaagttaaaataaggctagtccgttatcaacttgaaaaagtggcaccgagtcggtgcgaggtattg

SEQ ID NO: 36318 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattg

SEQ ID NO: 36319 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattg

SEQ ID NO: 36320 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattg

SEQ ID NO: 36321 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattg

SEQ ID NO: 36322 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattg

SEQ ID NO: 36323 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattg

SEQ ID NO: 36324 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattg

SEQ ID NO: 36325 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattg

SEQ ID NO: 36326 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattg

SEQ ID NO: 36327 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattg

SEQ ID NO: 36328 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgccgaggtattg

SEQ ID NO: 36329 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattg

SEQ ID NO: 36330 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattg

SEQ ID NO: 36331 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattg

SEQ ID NO: 36332 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattg

SEQ ID NO: 36333 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattg

SEQ ID NO: 36334 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcccgaggtattg

SEQ ID NO: 36335 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcgccgaggtattg

SEQ ID NO: 36336 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcggccgaggtattg

SEQ ID NO: 36337 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcgggccgaggtattg

SEQ ID NO: 36338 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcagggccgaggtattgt

SEQ ID NO: 36339 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcaagggccgaggtattgt

SEQ ID NO: 36340 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgaagggccgaggtattgt

SEQ ID NO: 36341 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcagaagggccgaggtattgt

SEQ ID NO: 36342 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgagaagggccgaggtattgt

SEQ ID NO: 36343 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgctgagaagggccgaggtattgt

SEQ ID NO: 36344 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcctgagaagggccgaggtattgt

SEQ ID NO: 36345 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcactgagaagggccgaggtattgt

SEQ ID NO: 36346 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcaactgagaagggccgaggtattgt

SEQ ID NO: 36347 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgaactgagaagggccgaggtattgt

SEQ ID NO: 36348 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgccgaactgagaagggccgaggtattgt

SEQ ID NO: 36349 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgt

SEQ ID NO: 36350 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgt

SEQ ID NO: 36351 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgt

SEQ ID NO: 36352 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgt

SEQ ID NO: 36353 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgt

SEQ ID NO: 36354 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgt

SEQ ID NO: 36355 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgt

SEQ ID NO: 36356 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgt

SEQ ID NO: 36357 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgt

SEQ ID NO: 36358 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgt

SEQ ID NO: 36359 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgt

SEQ ID NO: 36360 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgt

SEQ ID NO: 36361 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgt

SEQ ID NO: 36362 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgt

SEQ ID NO: 36363 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgt

SEQ ID NO: 36364 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgt

SEQ ID NO: 36365 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgt

SEQ ID NO: 36366 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgt

SEQ ID NO: 36367 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgt

SEQ ID NO: 36368 - DNA, 106 bp, synthetic construct
  source 1..106: mol_type = other DNA
actttgctgccacaatacctgttttagagctagaaatagcaagttaaaataaggctagtccgttatcaacttgaaaaagtggcaccgagtcggtgcgaggtattgt

SEQ ID NO: 36369 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgt

SEQ ID NO: 36370 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgt

SEQ ID NO: 36371 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgt

SEQ ID NO: 36372 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgt

SEQ ID NO: 36373 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgt

SEQ ID NO: 36374 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgt

SEQ ID NO: 36375 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgt

SEQ ID NO: 36376 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgt

SEQ ID NO: 36377 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgt

SEQ ID NO: 36378 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgt

SEQ ID NO: 36379 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgccgaggtattgt

SEQ ID NO: 36380 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgt

SEQ ID NO: 36381 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgt

SEQ ID NO: 36382 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgt

SEQ ID NO: 36383 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgt

SEQ ID NO: 36384 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgt

SEQ ID NO: 36385 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcccgaggtattgt

SEQ ID NO: 36386 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcgccgaggtattgt

SEQ ID NO: 36387 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcggccgaggtattgt

SEQ ID NO: 36388 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcgggccgaggtattgt

SEQ ID NO: 36389 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcagggccgaggtattgtg

SEQ ID NO: 36390 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcaagggccgaggtattgtg

SEQ ID NO: 36391 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgaagggccgaggtattgtg

SEQ ID NO: 36392 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcagaagggccgaggtattgtg

SEQ ID NO: 36393 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgagaagggccgaggtattgtg

SEQ ID NO: 36394 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgctgagaagggccgaggtattgtg

SEQ ID NO: 36395 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcctgagaagggccgaggtattgtg

SEQ ID NO: 36396 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcactgagaagggccgaggtattgtg

SEQ ID NO: 36397 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcaactgagaagggccgaggtattgtg

SEQ ID NO: 36398 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgaactgagaagggccgaggtattgtg

SEQ ID NO: 36399 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgccgaactgagaagggccgaggtattgtg

SEQ ID NO: 36400 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtg

SEQ ID NO: 36401 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtg

SEQ ID NO: 36402 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtg

SEQ ID NO: 36403 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtg

SEQ ID NO: 36404 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtg

SEQ ID NO: 36405 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtg

SEQ ID NO: 36406 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtg

SEQ ID NO: 36407 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtg

SEQ ID NO: 36408 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtg

SEQ ID NO: 36409 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtg

SEQ ID NO: 36410 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtg

SEQ ID NO: 36411 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtg

SEQ ID NO: 36412 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtg

SEQ ID NO: 36413 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtg

SEQ ID NO: 36414 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtg

SEQ ID NO: 36415 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtg

SEQ ID NO: 36416 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtg

SEQ ID NO: 36417 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtg

SEQ ID NO: 36418 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtg

SEQ ID NO: 36419 - DNA, 107 bp, synthetic construct
  source 1..107: mol_type = other DNA
actttgctgccacaatacctgttttagagctagaaatagcaagttaaaataaggctagtccgttatcaacttgaaaaagtggcaccgagtcggtgcgaggtattgtg

SEQ ID NO: 36420 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtg

SEQ ID NO: 36421 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtg

SEQ ID NO: 36422 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtg

SEQ ID NO: 36423 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtg

SEQ ID NO: 36424 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtg

SEQ ID NO: 36425 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtg

SEQ ID NO: 36426 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtg

SEQ ID NO: 36427 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtg

SEQ ID NO: 36428 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtg

SEQ ID NO: 36429 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtg

SEQ ID NO: 36430 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgccgaggtattgtg

SEQ ID NO: 36431 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtg

SEQ ID NO: 36432 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtg

SEQ ID NO: 36433 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtg

SEQ ID NO: 36434 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtg

SEQ ID NO: 36435 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtg

SEQ ID NO: 36436 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcccgaggtattgtg

SEQ ID NO: 36437 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcgccgaggtattgtg

SEQ ID NO: 36438 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcggccgaggtattgtg

SEQ ID NO: 36439 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgggccgaggtattgtg

SEQ ID NO: 36440 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcagggccgaggtattgtgg

SEQ ID NO: 36441 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcaagggccgaggtattgtgg

SEQ ID NO: 36442 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgaagggccgaggtattgtgg

SEQ ID NO: 36443 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcagaagggccgaggtattgtgg

SEQ ID NO: 36444 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgagaagggccgaggtattgtgg

SEQ ID NO: 36445 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgctgagaagggccgaggtattgtgg

SEQ ID NO: 36446 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcctgagaagggccgaggtattgtgg

SEQ ID NO: 36447 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcactgagaagggccgaggtattgtgg

SEQ ID NO: 36448 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcaactgagaagggccgaggtattgtgg

SEQ ID NO: 36449 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgaactgagaagggccgaggtattgtgg

SEQ ID NO: 36450 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgccgaactgagaagggccgaggtattgtgg

SEQ ID NO: 36451 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtgg

SEQ ID NO: 36452 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtgg

SEQ ID NO: 36453 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtgg

SEQ ID NO: 36454 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtgg

SEQ ID NO: 36455 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtgg

SEQ ID NO: 36456 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtgg

SEQ ID NO: 36457 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtgg

SEQ ID NO: 36458 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtgg

SEQ ID NO: 36459 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtgg

SEQ ID NO: 36460 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtgg

SEQ ID NO: 36461 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtgg

SEQ ID NO: 36462 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtgg

SEQ ID NO: 36463 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtgg

SEQ ID NO: 36464 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtgg

SEQ ID NO: 36465 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtgg

SEQ ID NO: 36466 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtgg

SEQ ID NO: 36467 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtgg

SEQ ID NO: 36468 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtgg

SEQ ID NO: 36469 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtgg

SEQ ID NO: 36470 - DNA, 108 bp, synthetic construct
  source 1..108: mol_type = other DNA
actttgctgccacaatacctgttttagagctagaaatagcaagttaaaataaggctagtccgttatcaacttgaaaaagtggcaccgagtcggtgcgaggtattgtgg

SEQ ID NO: 36471 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtgg

SEQ ID NO: 36472 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtgg

SEQ ID NO: 36473 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtgg

SEQ ID NO: 36474 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtgg

SEQ ID NO: 36475 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtgg

SEQ ID NO: 36476 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtgg

SEQ ID NO: 36477 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtgg

SEQ ID NO: 36478 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtgg

SEQ ID NO: 36479 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtgg

SEQ ID NO: 36480 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtgg

SEQ ID NO: 36481 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgccgaggtattgtgg

SEQ ID NO: 36482 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtgg

SEQ ID NO: 36483 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtgg

SEQ ID NO: 36484 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtgg

SEQ ID NO: 36485 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtgg

SEQ ID NO: 36486 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtgg

SEQ ID NO: 36487 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgcccgaggtattgtgg

SEQ ID NO: 36488 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcgccgaggtattgtgg

SEQ ID NO: 36489 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcggccgaggtattgtgg

SEQ ID NO: 36490 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgggccgaggtattgtgg

SEQ ID NO: 36491 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcagggccgaggtattgtggc

SEQ ID NO: 36492 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcaagggccgaggtattgtggc

SEQ ID NO: 36493 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaagggccgaggtattgtggc

SEQ ID NO: 36494 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcagaagggccgaggtattgtggc

SEQ ID NO: 36495 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaagggccgaggtattgtggc

SEQ ID NO: 36496 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgctgagaagggccgaggtattgtggc

SEQ ID NO: 36497 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaagggccgaggtattgtggc

SEQ ID NO: 36498 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcactgagaagggccgaggtattgtggc

SEQ ID NO: 36499 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaagggccgaggtattgtggc

SEQ ID NO: 36500 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgaactgagaagggccgaggtattgtggc

SEQ ID NO: 36501 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaagggccgaggtattgtggc

SEQ ID NO: 36502 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgcgaactgagaagggccgaggtattgtggc

SEQ ID NO: 36503 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcagcgaactgagaagggccgaggtattgtggc

SEQ ID NO: 36504 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctagcgaactgagaagggccgaggtattgtggc

SEQ ID NO: 36505 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgtagcgaactgagaagggccgaggtattgtggc

SEQ ID NO: 36506 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgccgtagcgaactgagaagggccgaggtattgtggc

SEQ ID NO: 36507 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctcgtagcgaactgagaagggccgaggtattgtggc

SEQ ID NO: 36508 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgtcgtagcgaactgagaagggccgaggtattgtggc

SEQ ID NO: 36509 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcggtcgtagcgaactgagaagggccgaggtattgtggc

SEQ ID NO: 36510 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgcgggtcgtagcgaactgagaagggccgaggtattgtggc

SEQ ID NO: 36511 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggc

SEQ ID NO: 36512 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgcatgggtcgtagcgaactgagaagggccgaggtattgtggc

SEQ ID NO: 36513 - DNA, 137 bp, synthetic construct
  source 1..137: mol_type = other DNA
actttgctgccacaatacctgttttagagctagaaatagcaagttaaaataaggctagtccgttatcaacttgaaaaagtggcaccgagtcggtgctatgggtcgtagcgaactgagaagggccgaggtattgtggc

SEQ ID NO: 36514 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgcgtatgggtcgtagcgaactgagaagggccgaggtattgtggc

SEQ ID NO: 36515 - DNA, 139 bp, synthetic construct
  source 1..139: mol_type = other DNA
actttgctgccacaatacctgttttagagctagaaatagcaagttaaaataaggctagtccgttatcaacttgaaaaagtggcaccgagtcggtgctgtatgggtcgtagcgaactgagaagggccgaggtattgtggc

SEQ ID NO: 36516 - DNA, 140 bp, synthetic construct
  source 1..140: mol_type = other DNA
actttgctgccacaatacctgttttagagctagaaatagcaagttaaaataaggctagtccgttatcaacttgaaaaagtggcaccgagtcggtgcgtgtatgggtcgtagcgaactgagaagggccgaggtattgtggc

SEQ ID NO: 36517 - DNA, 141 bp, synthetic construct
  source 1..141: mol_type = other DNA
actttgctgccacaatacctgttttagagctagaaatagcaagttaaaataaggctagtccgttatcaacttgaaaaagtggcaccgagtcggtgcggtgtatgggtcgtagcgaactgagaagggccgaggtattgtggc

SEQ ID NO: 36518 - DNA, 142 bp, synthetic construct
  source 1..142: mol_type = other DNA
actttgctgccacaatacctgttttagagctagaaatagcaagttaaaataaggctagtccgttatcaacttgaaaaagtggcaccgagtcggtgcgggtgtatgggtcgtagcgaactgagaagggccgaggtattgtggc

SEQ ID NO: 36519 - DNA, 143 bp, synthetic construct
  source 1..143: mol_type = other DNA
actttgctgccacaatacctgttttagagctagaaatagcaagttaaaataaggctagtccgttatcaacttgaaaaagtggcaccgagtcggtgctgggtgtatgggtcgtagcgaactgagaagggccgaggtattgtggc

SEQ ID NO: 36520 - DNA, 144 bp, synthetic construct
  source 1..144: mol_type = other DNA
actttgctgccacaatacctgttttagagctagaaatagcaagttaaaataaggctagtccgttatcaacttgaaaaagtggcaccgagtcggtgcttgggtgtatgggtcgtagcgaactgagaagggccgaggtattgtggc

SEQ ID NO: 36521 - DNA, 109 bp, synthetic construct
  source 1..109: mol_type = other DNA
actttgctgccacaatacctgttttagagctagaaatagcaagttaaaataaggctagtccgttatcaacttgaaaaagtggcaccgagtcggtgcgaggtattgtggc

SEQ ID NO: 36522 - DNA, 145 bp, synthetic construct
  source 1..145: mol_type = other DNA
actttgctgccacaatacctgttttagagctagaaatagcaagttaaaataaggctagtccgttatcaacttgaaaaagtggcaccgagtcggtgctttgggtgtatgggtcgtagcgaactgagaagggccgaggtattgtggc

SEQ ID NO: 36523 - DNA, 146 bp, synthetic construct
  source 1..146: mol_type = other DNA
actttgctgccacaatacctgttttagagctagaaatagcaagttaaaataaggctagtccgttatcaacttgaaaaagtggcaccgagtcggtgcctttgggtgtatgggtcgtagcgaactgagaagggccgaggtattgtggc

SEQ ID NO: 36524 - DNA, 147 bp, synthetic construct
  source 1..147: mol_type = other DNA
actttgctgccacaatacctgttttagagctagaaatagcaagttaaaataaggctagtccgttatcaacttgaaaaagtggcaccgagtcggtgccctttgggtgtatgggtcgtagcgaactgagaagggccgaggtattgtggc

SEQ ID NO: 36525 - DNA, 148 bp, synthetic construct
  source 1..148: mol_type = other DNA
actttgctgccacaatacctgttttagagctagaaatagcaagttaaaataaggctagtccgttatcaacttgaaaaagtggcaccgagtcggtgctcctttgggtgtatgggtcgtagcgaactgagaagggccgaggtattgtggc

SEQ ID NO: 36526 - DNA, 149 bp, synthetic construct
  source 1..149: mol_type = other DNA
actttgctgccacaatacctgttttagagctagaaatagcaagttaaaataaggctagtccgttatcaacttgaaaaagtggcaccgagtcggtgcatcctttgggtgtatgggtcgtagcgaactgagaagggccgaggtattgtggc

SEQ ID NO: 36527 - DNA, 150 bp, synthetic construct
  source 1..150: mol_type = other DNA
actttgctgccacaatacctgttttagagctagaaatagcaagttaaaataaggctagtccgttatcaacttgaaaaagtggcaccgagtcggtgcaatcctttgggtgtatgggtcgtagcgaactgagaagggccgaggtattgtggc

SEQ ID NO: 36528 - DNA, 151 bp, synthetic construct
  source 1..151: mol_type = other DNA
actttgctgccacaatacctgttttagagctagaaatagcaagttaaaataaggctagtccgttatcaacttgaaaaagtggcaccgagtcggtgccaatcctttgggtgtatgggtcgtagcgaactgagaagggccgaggtattgtggc

SEQ ID NO: 36529 - DNA, 152 bp, synthetic construct
  source 1..152: mol_type = other DNA
actttgctgccacaatacctgttttagagctagaaatagcaagttaaaataaggctagtccgttatcaacttgaaaaagtggcaccgagtcggtgctcaatcctttgggtgtatgggtcgtagcgaactgagaagggccgaggtattgtggc

SEQ ID NO: 36530 - DNA, 153 bp, synthetic construct
  source 1..153: mol_type = other DNA
actttgctgccacaatacctgttttagagctagaaatagcaagttaaaataaggctagtccgttatcaacttgaaaaagtggcaccgagtcggtgcctcaatcctttgggtgtatgggtcgtagcgaactgagaagggccgaggtattgtggc

SEQ ID NO: 36531 - DNA, 154 bp, synthetic construct
  source 1..154: mol_type = other DNA
actttgctgccacaatacctgttttagagctagaaatagcaagttaaaataaggctagtccgttatcaacttgaaaaagtggcaccgagtcggtgccctcaatcctttgggtgtatgggtcgtagcgaactgagaagggccgaggtattgtggc

SEQ ID NO: 36532 - DNA, 110 bp, synthetic construct
  source 1..110: mol_type = other DNA
actttgctgccacaatacctgttttagagctagaaatagcaagttaaaataaggctagtccgttatcaacttgaaaaagtggcaccgagtcggtgccgaggtattgtggc

SEQ ID NO: 36533 - DNA, 155 bp, synthetic construct
  source 1..155: mol_type = other DNA
actttgctgccacaatacctgttttagagctagaaatagcaagttaaaataaggctagtccgttatcaacttgaaaaagtggcaccgagtcggtgcacctcaatcctttgggtgtatgggtcgtagcgaactgagaagggccgaggtattgtggc

SEQ ID NO: 36534 - DNA, 156 bp, synthetic construct
  source 1..156: mol_type = other DNA
actttgctgccacaatacctgttttagagctagaaatagcaagttaaaataaggctagtccgttatcaacttgaaaaagtggcaccgagtcggtgcgacctcaatcctttgggtgtatgggtcgtagcgaactgagaagggccgaggtattgtggc

SEQ ID NO: 36535 - DNA, 157 bp, synthetic construct
  source 1..157: mol_type = other DNA
actttgctgccacaatacctgttttagagctagaaatagcaagttaaaataaggctagtccgttatcaacttgaaaaagtggcaccgagtcggtgcagacctcaatcctttgggtgtatgggtcgtagcgaactgagaagggccgaggtattgtggc

SEQ ID NO: 36536 - DNA, 158 bp, synthetic construct
  source 1..158: mol_type = other DNA
actttgctgccacaatacctgttttagagctagaaatagcaagttaaaataaggctagtccgttatcaacttgaaaaagtggcaccgagtcggtgcaagacctcaatcctttgggtgtatgggtcgtagcgaactgagaagggccgaggtattgtggc

SEQ ID NO: 36537 - DNA, 159 bp, synthetic construct
  source 1..159: mol_type = other DNA
actttgctgccacaatacctgttttagagctagaaatagcaagttaaaataaggctagtccgttatcaacttgaaaaagtggcaccgagtcggtgccaagacctcaatcctttgggtgtatgggtcgtagcgaactgagaagggccgaggtattgtggc

SEQ ID NO: 36538 - DNA, 111 bp, synthetic construct
  source 1..111: mol_type = other DNA
actttgctgccacaatacctgttttagagctagaaatagcaagttaaaataaggctagtccgttatcaacttgaaaaagtggcaccgagtcggtgcccgaggtattgtggc

SEQ ID NO: 36539 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgccgaggtattgtggc

SEQ ID NO: 36540 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcggccgaggtattgtggc

SEQ ID NO: 36541 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgggccgaggtattgtggc

SEQ ID NO: 36542 - DNA, 123 bp, synthetic construct; identical to SEQ ID NO: 32928
  source 1..123: mol_type = other DNA

SEQ ID NO: 36543 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaataccgcggcccttctcagttcgcta

SEQ ID NO: 36544 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaatccctcggcccttctcagttcgcta

SEQ ID NO: 36545 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaatacctcgccccttctcagttcgcta

SEQ ID NO: 36546 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaataccgcgccccttctcagttcgcta

SEQ ID NO: 36547 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaataccgcgcccattctcagttcgcta

SEQ ID NO: 36548 - DNA, 121 bp, synthetic construct; identical to SEQ ID NO: 33693
  source 1..121: mol_type = other DNA

SEQ ID NO: 36549 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaataccgcggcccttctcagttcgc

SEQ ID NO: 36550 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaatccctcggcccttctcagttcgc

SEQ ID NO: 36551 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaatacctcgccccttctcagttcgc

SEQ ID NO: 36552 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaataccgcgccccttctcagttcgc

SEQ ID NO: 36553 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaataccgcgcccattctcagttcgc

SEQ ID NO: 36554 - DNA, 122 bp, synthetic construct; identical to SEQ ID NO: 33744
  source 1..122: mol_type = other DNA

SEQ ID NO: 36555 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaataccgcggcccttctcagttcgct

SEQ ID NO: 36556 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaatccctcggcccttctcagttcgct

SEQ ID NO: 36557 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaatacctcgccccttctcagttcgct

SEQ ID NO: 36558 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaataccgcgccccttctcagttcgct

SEQ ID NO: 36559 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaataccgcgcccattctcagttcgct

SEQ ID NO: 36560 - DNA, 125 bp, synthetic construct; identical to SEQ ID NO: 32930
  source 1..125: mol_type = other DNA

SEQ ID NO: 36561 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaataccgcggcccttctcagttcgcta

SEQ ID NO: 36562 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaatccctcggcccttctcagttcgcta

SEQ ID NO: 36563 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaatacctcgccccttctcagttcgcta

SEQ ID NO: 36564 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaataccgcgccccttctcagttcgcta

SEQ ID NO: 36565 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaataccgcgcccattctcagttcgcta

SEQ ID NO: 36566 - DNA, 123 bp, synthetic construct; identical to SEQ ID NO: 33695
  source 1..123: mol_type = other DNA

SEQ ID NO: 36567 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaataccgcggcccttctcagttcgc

SEQ ID NO: 36568 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaatccctcggcccttctcagttcgc

SEQ ID NO: 36569 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaatacctcgccccttctcagttcgc

SEQ ID NO: 36570 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaataccgcgccccttctcagttcgc

SEQ ID NO: 36571 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaataccgcgcccattctcagttcgc

SEQ ID NO: 36572 - DNA, 124 bp, synthetic construct; identical to SEQ ID NO: 33746
  source 1..124: mol_type = other DNA

SEQ ID NO: 36573 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaataccgcggcccttctcagttcgct

SEQ ID NO: 36574 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaatccctcggcccttctcagttcgct

SEQ ID NO: 36575 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaatacctcgccccttctcagttcgct

SEQ ID NO: 36576 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaataccgcgccccttctcagttcgct

SEQ ID NO: 36577 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaataccgcgcccattctcagttcgct

SEQ ID NO: 36578 - DNA, 127 bp, synthetic construct; identical to SEQ ID NO: 32932
  source 1..127: mol_type = other DNA

SEQ ID NO: 36579 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaataccgcggcccttctcagttcgcta

SEQ ID NO: 36580 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaatccctcggcccttctcagttcgcta

SEQ ID NO: 36581 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaatacctcgccccttctcagttcgcta

SEQ ID NO: 36582 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaataccgcgccccttctcagttcgcta

SEQ ID NO: 36583 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaataccgcgcccattctcagttcgcta

SEQ ID NO: 36584 - DNA, 125 bp, synthetic construct; identical to SEQ ID NO: 33697
  source 1..125: mol_type = other DNA

SEQ ID NO: 36585 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaataccgcggcccttctcagttcgc

SEQ ID NO: 36586 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaatccctcggcccttctcagttcgc

SEQ ID NO: 36587 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaatacctcgccccttctcagttcgc

SEQ ID NO: 36588 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaataccgcgccccttctcagttcgc

SEQ ID NO: 36589 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaataccgcgcccattctcagttcgc

SEQ ID NO: 36590 - DNA, 126 bp, synthetic construct; identical to SEQ ID NO: 33748
  source 1..126: mol_type = other DNA

SEQ ID NO: 36591 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaataccgcggcccttctcagttcgct

SEQ ID NO: 36592 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaatccctcggcccttctcagttcgct

SEQ ID NO: 36593 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaatacctcgccccttctcagttcgct

SEQ ID NO: 36594 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaataccgcgccccttctcagttcgct

SEQ ID NO: 36595 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaataccgcgcccattctcagttcgct

SEQ ID NO: 36596 - DNA, 129 bp, synthetic construct; identical to SEQ ID NO: 32934
  source 1..129: mol_type = other DNA

SEQ ID NO: 36597 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaataccgcggcccttctcagttcgcta

SEQ ID NO: 36598 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaatccctcggcccttctcagttcgcta

SEQ ID NO: 36599 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaatacctcgccccttctcagttcgcta

SEQ ID NO: 36600 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaataccgcgccccttctcagttcgcta

SEQ ID NO: 36601 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaataccgcgcccattctcagttcgcta

SEQ ID NO: 36602 - DNA, 127 bp, synthetic construct; identical to SEQ ID NO: 33699
  source 1..127: mol_type = other DNA

SEQ ID NO: 36603 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaataccgcggcccttctcagttcgc

SEQ ID NO: 36604 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaatccctcggcccttctcagttcgc

SEQ ID NO: 36605 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaatacctcgccccttctcagttcgc

SEQ ID NO: 36606 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaataccgcgccccttctcagttcgc

SEQ ID NO: 36607 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaataccgcgcccattctcagttcgc

SEQ ID NO: 36608 - DNA, 128 bp, synthetic construct; identical to SEQ ID NO: 33750
  source 1..128: mol_type = other DNA

SEQ ID NO: 36609 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaataccgcggcccttctcagttcgct

SEQ ID NO: 36610 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaatccctcggcccttctcagttcgct

SEQ ID NO: 36611 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaatacctcgccccttctcagttcgct

SEQ ID NO: 36612 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaataccgcgccccttctcagttcgct

SEQ ID NO: 36613 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaataccgcgcccattctcagttcgct

SEQ ID NO: 36614 - DNA, 131 bp, synthetic construct; identical to SEQ ID NO: 32936
  source 1..131: mol_type = other DNA

SEQ ID NO: 36615 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaataccgcggcccttctcagttcgcta

SEQ ID NO: 36616 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaatccctcggcccttctcagttcgcta

SEQ ID NO: 36617 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaatacctcgccccttctcagttcgcta

SEQ ID NO: 36618 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaataccgcgccccttctcagttcgcta

SEQ ID NO: 36619 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaataccgcgcccattctcagttcgcta

SEQ ID NO: 36620 - DNA, 129 bp, synthetic construct; identical to SEQ ID NO: 33701
  source 1..129: mol_type = other DNA

SEQ ID NO: 36621 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaataccgcggcccttctcagttcgc

SEQ ID NO: 36622 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaatccctcggcccttctcagttcgc

SEQ ID NO: 36623 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaatacctcgccccttctcagttcgc

SEQ ID NO: 36624 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaataccgcgccccttctcagttcgc

SEQ ID NO: 36625 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaataccgcgcccattctcagttcgc

SEQ ID NO: 36626 - DNA, 130 bp, synthetic construct; identical to SEQ ID NO: 33752
  source 1..130: mol_type = other DNA

SEQ ID NO: 36627 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaataccgcggcccttctcagttcgct

SEQ ID NO: 36628 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaatccctcggcccttctcagttcgct

SEQ ID NO: 36629 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaatacctcgccccttctcagttcgct

SEQ ID NO: 36630 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaataccgcgccccttctcagttcgct

SEQ ID NO: 36631 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaataccgcgcccattctcagttcgct

SEQ ID NO: 36632 - DNA, 122 bp, synthetic construct; identical to SEQ ID NO: 33845
  source 1..122: mol_type = other DNA

SEQ ID NO: 36633 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaataccgcggcccttctcagttcgct

SEQ ID NO: 36634 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaatacctcgccccttctcagttcgct

SEQ ID NO: 36635 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaatacctcgcccattctcagttcgct

SEQ ID NO: 36636 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaataccgcgccccttctcagttcgct

SEQ ID NO: 36637 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaataccgcgcccattctcagttcgct

SEQ ID NO: 36638 - DNA, 120 bp, synthetic construct; identical to SEQ ID NO: 34610
  source 1..120: mol_type = other DNA

SEQ ID NO: 36639 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaataccgcggcccttctcagttcg

SEQ ID NO: 36640 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaatacctcgccccttctcagttcg

SEQ ID NO: 36641 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaatacctcgcccattctcagttcg

SEQ ID NO: 36642 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaataccgcgccccttctcagttcg

SEQ ID NO: 36643 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaataccgcgcccattctcagttcg

SEQ ID NO: 36644 - DNA, 121 bp, synthetic construct; identical to SEQ ID NO: 34661
  source 1..121: mol_type = other DNA

SEQ ID NO: 36645 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaataccgcggcccttctcagttcgc

SEQ ID NO: 36646 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaatacctcgccccttctcagttcgc

SEQ ID NO: 36647 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaatacctcgcccattctcagttcgc

SEQ ID NO: 36648 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaataccgcgccccttctcagttcgc

SEQ ID NO: 36649 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaataccgcgcccattctcagttcgc

SEQ ID NO: 36650 - DNA, 124 bp, synthetic construct; identical to SEQ ID NO: 33847
  source 1..124: mol_type = other DNA

SEQ ID NO: 36651 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaataccgcggcccttctcagttcgct

SEQ ID NO: 36652 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaatacctcgccccttctcagttcgct

SEQ ID NO: 36653 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaatacctcgcccattctcagttcgct

SEQ ID NO: 36654 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaataccgcgccccttctcagttcgct

SEQ ID NO: 36655 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaataccgcgcccattctcagttcgct

SEQ ID NO: 36656 - DNA, 122 bp, synthetic construct; identical to SEQ ID NO: 34612
  source 1..122: mol_type = other DNA

SEQ ID NO: 36657 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaataccgcggcccttctcagttcg

SEQ ID NO: 36658 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaatacctcgccccttctcagttcg

SEQ ID NO: 36659 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaatacctcgcccattctcagttcg

SEQ ID NO: 36660 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaataccgcgccccttctcagttcg

SEQ ID NO: 36661 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaataccgcgcccattctcagttcg

SEQ ID NO: 36662 - DNA, 123 bp, synthetic construct; identical to SEQ ID NO: 34663
  source 1..123: mol_type = other DNA

SEQ ID NO: 36663 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaataccgcggcccttctcagttcgc

SEQ ID NO: 36664 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaatacctcgccccttctcagttcgc

SEQ ID NO: 36665 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaatacctcgcccattctcagttcgc

SEQ ID NO: 36666 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaataccgcgccccttctcagttcgc

SEQ ID NO: 36667 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaataccgcgcccattctcagttcgc

SEQ ID NO: 36668 - DNA, 126 bp, synthetic construct; identical to SEQ ID NO: 33849
  source 1..126: mol_type = other DNA

SEQ ID NO: 36669 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaataccgcggcccttctcagttcgct

SEQ ID NO: 36670 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaatacctcgccccttctcagttcgct

SEQ ID NO: 36671 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaatacctcgcccattctcagttcgct

SEQ ID NO: 36672 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaataccgcgccccttctcagttcgct

SEQ ID NO: 36673 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaataccgcgcccattctcagttcgct

SEQ ID NO: 36674 - DNA, 124 bp, synthetic construct; identical to SEQ ID NO: 34614
  source 1..124: mol_type = other DNA

SEQ ID NO: 36675 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaataccgcggcccttctcagttcg

SEQ ID NO: 36676 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaatacctcgccccttctcagttcg

SEQ ID NO: 36677 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaatacctcgcccattctcagttcg

SEQ ID NO: 36678 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaataccgcgccccttctcagttcg

SEQ ID NO: 36679 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaataccgcgcccattctcagttcg

SEQ ID NO: 36680 - DNA, 125 bp, synthetic construct; identical to SEQ ID NO: 34665
  source 1..125: mol_type = other DNA

SEQ ID NO: 36681 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaataccgcggcccttctcagttcgc

SEQ ID NO: 36682 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaatacctcgccccttctcagttcgc

SEQ ID NO: 36683 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaatacctcgcccattctcagttcgc

SEQ ID NO: 36684 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaataccgcgccccttctcagttcgc

SEQ ID NO: 36685 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaataccgcgcccattctcagttcgc

SEQ ID NO: 36686 - DNA, 128 bp, synthetic construct; identical to SEQ ID NO: 33851
  source 1..128: mol_type = other DNA

SEQ ID NO: 36687 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaataccgcggcccttctcagttcgct

SEQ ID NO: 36688 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaatacctcgccccttctcagttcgct

SEQ ID NO: 36689 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaatacctcgcccattctcagttcgct

SEQ ID NO: 36690 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaataccgcgccccttctcagttcgct

SEQ ID NO: 36691 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaataccgcgcccattctcagttcgct

SEQ ID NO: 36692 - DNA, 126 bp, synthetic construct; identical to SEQ ID NO: 34616
  source 1..126: mol_type = other DNA

SEQ ID NO: 36693 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaataccgcggcccttctcagttcg

SEQ ID NO: 36694 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaatacctcgccccttctcagttcg

SEQ ID NO: 36695 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaatacctcgcccattctcagttcg

SEQ ID NO: 36696 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaataccgcgccccttctcagttcg

SEQ ID NO: 36697 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaataccgcgcccattctcagttcg

SEQ ID NO: 36698 - DNA, 127 bp, synthetic construct; identical to SEQ ID NO: 34667
  source 1..127: mol_type = other DNA

SEQ ID NO: 36699 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaataccgcggcccttctcagttcgc

SEQ ID NO: 36700 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaatacctcgccccttctcagttcgc

SEQ ID NO: 36701 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaatacctcgcccattctcagttcgc

SEQ ID NO: 36702 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaataccgcgccccttctcagttcgc

SEQ ID NO: 36703 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaataccgcgcccattctcagttcgc

SEQ ID NO: 36704 - DNA, 130 bp, synthetic construct; identical to SEQ ID NO: 33853
  source 1..130: mol_type = other DNA

SEQ ID NO: 36705 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaataccgcggcccttctcagttcgct

SEQ ID NO: 36706 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaatacctcgccccttctcagttcgct

SEQ ID NO: 36707 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaatacctcgcccattctcagttcgct

SEQ ID NO: 36708 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaataccgcgccccttctcagttcgct

SEQ ID NO: 36709 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaataccgcgcccattctcagttcgct

SEQ ID NO: 36710 - DNA, 128 bp, synthetic construct; identical to SEQ ID NO: 34618
  source 1..128: mol_type = other DNA

SEQ ID NO: 36711 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaataccgcggcccttctcagttcg

SEQ ID NO: 36712 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaatacctcgccccttctcagttcg

SEQ ID NO: 36713 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaatacctcgcccattctcagttcg

SEQ ID NO: 36714 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaataccgcgccccttctcagttcg

SEQ ID NO: 36715 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaataccgcgcccattctcagttcg

SEQ ID NO: 36716 - DNA, 129 bp, synthetic construct; identical to SEQ ID NO: 34669
  source 1..129: mol_type = other DNA

SEQ ID NO: 36717 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaataccgcggcccttctcagttcgc

SEQ ID NO: 36718 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaatacctcgccccttctcagttcgc

SEQ ID NO: 36719 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaatacctcgcccattctcagttcgc

SEQ ID NO: 36720 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaataccgcgccccttctcagttcgc

SEQ ID NO: 36721 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaataccgcgcccattctcagttcgc

SEQ ID NO: 36722 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcaataccgcgccccttctcag

SEQ ID NO: 36723 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaataccgcgccccttctcag

SEQ ID NO: 36724 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaataccgcgccccttctcag

SEQ ID NO: 36725 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaataccgcgccccttctcag

SEQ ID NO: 36726 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcag

SEQ ID NO: 36727 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcag

SEQ ID NO: 36728 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcag

SEQ ID NO: 36729 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcag

SEQ ID NO: 36730 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgctaccgcgccccttctcag

SEQ ID NO: 36731 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcaataccgcgccccttctcagt

SEQ ID NO: 36732 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcacaataccgcgccccttctcagt

SEQ ID NO: 36733 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcccacaataccgcgccccttctcagt

SEQ ID NO: 36734 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgctgccacaataccgcgccccttctcagt

SEQ ID NO: 36735 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagt

SEQ ID NO: 36736 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagt

SEQ ID NO: 36737 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagt

SEQ ID NO: 36738 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagt

SEQ ID NO: 36739 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgctaccgcgccccttctcagt

SEQ ID NO: 36740 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcaataccgcgccccttctcagtt

SEQ ID NO: 36741 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcacaataccgcgccccttctcagtt

SEQ ID NO: 36742 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcccacaataccgcgccccttctcagtt

SEQ ID NO: 36743 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgctgccacaataccgcgccccttctcagtt

SEQ ID NO: 36744 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagtt

SEQ ID NO: 36745 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagtt

SEQ ID NO: 36746 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagtt

SEQ ID NO: 36747 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagtt

SEQ ID NO: 36748 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgctaccgcgccccttctcagtt

SEQ ID NO: 36749 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcaataccgcgccccttctcagttc

SEQ ID NO: 36750 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcacaataccgcgccccttctcagttc

SEQ ID NO: 36751 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcccacaataccgcgccccttctcagttc

SEQ ID NO: 36752 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgctgccacaataccgcgccccttctcagttc

SEQ ID NO: 36753 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagttc

SEQ ID NO: 36754 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagttc

SEQ ID NO: 36755 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagttc

SEQ ID NO: 36756 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagttc

SEQ ID NO: 36757 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctaccgcgccccttctcagttc

SEQ ID NO: 36758 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcaataccgcgccccttctcagttcg

SEQ ID NO: 36759 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcacaataccgcgccccttctcagttcg

SEQ ID NO: 36760 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcccacaataccgcgccccttctcagttcg

SEQ ID NO: 36761 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgctgccacaataccgcgccccttctcagttcg

SEQ ID NO: 36762 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagttcg

SEQ ID NO: 36763 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagttcg

SEQ ID NO: 36764 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagttcg

SEQ ID NO: 36765 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagttcg

SEQ ID NO: 36766 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgctaccgcgccccttctcagttcg

SEQ ID NO: 36767 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcaataccgcgccccttctcagttcgc

SEQ ID NO: 36768 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcacaataccgcgccccttctcagttcgc

SEQ ID NO: 36769 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcccacaataccgcgccccttctcagttcgc

SEQ ID NO: 36770 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctgccacaataccgcgccccttctcagttcgc

SEQ ID NO: 36771 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagttcgc

SEQ ID NO: 36772 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagttcgc

SEQ ID NO: 36773 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagttcgc

SEQ ID NO: 36774 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagttcgc

SEQ ID NO: 36775 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctaccgcgccccttctcagttcgc

SEQ ID NO: 36776 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcaataccgcgccccttctcagttcgct

SEQ ID NO: 36777 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcacaataccgcgccccttctcagttcgct

SEQ ID NO: 36778 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcccacaataccgcgccccttctcagttcgct

SEQ ID NO: 36779 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctgccacaataccgcgccccttctcagttcgct

SEQ ID NO: 36780 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcgctgccacaataccgcgccccttctcagttcgct

SEQ ID NO: 36781 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctcagttcgct

SEQ ID NO: 36782 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctcagttcgct

SEQ ID NO: 36783 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctcagttcgct

SEQ ID NO: 36784 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctaccgcgccccttctcagttcgct

SEQ ID NO: 36785 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcaataccgcgccccttct

SEQ ID NO: 36786 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcacaataccgcgccccttct

SEQ ID NO: 36787 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcccacaataccgcgccccttct

SEQ ID NO: 36788 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctgccacaataccgcgccccttct

SEQ ID NO: 36789 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcgctgccacaataccgcgccccttct

SEQ ID NO: 36790 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcttgctgccacaataccgcgccccttct

SEQ ID NO: 36791 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttct

SEQ ID NO: 36792 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttct

SEQ ID NO: 36793 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgctaccgcgccccttct

SEQ ID NO: 36794 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcaataccgcgccccttctc

SEQ ID NO: 36795 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaataccgcgccccttctc

SEQ ID NO: 36796 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaataccgcgccccttctc

SEQ ID NO: 36797 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaataccgcgccccttctc

SEQ ID NO: 36798 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaataccgcgccccttctc

SEQ ID NO: 36799 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctc

SEQ ID NO: 36800 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctc

SEQ ID NO: 36801 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctc

SEQ ID NO: 36802 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgctaccgcgccccttctc

SEQ ID NO: 36803 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcaataccgcgccccttctca

SEQ ID NO: 36804 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaataccgcgccccttctca

SEQ ID NO: 36805 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaataccgcgccccttctca

SEQ ID NO: 36806 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaataccgcgccccttctca

SEQ ID NO: 36807 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaataccgcgccccttctca

SEQ ID NO: 36808 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaataccgcgccccttctca

SEQ ID NO: 36809 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcctttgctgccacaataccgcgccccttctca

SEQ ID NO: 36810 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcaactttgctgccacaataccgcgccccttctca

SEQ ID NO: 36811 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgctaccgcgccccttctca

SEQ ID NO: 36812 - DNA, 118 bp, synthetic construct; identical to SEQ ID NO: 34759
  source 1..118: mol_type = other DNA

SEQ ID NO: 36813 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaataccgcggcccttctcag

SEQ ID NO: 36814 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaatccctcggcccttctcag

SEQ ID NO: 36815 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaatcccgcggcccttctcag

SEQ ID NO: 36816 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaatacctcgccccttctcag

SEQ ID NO: 36817 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacgatacctcggcccttctcag

SEQ ID NO: 36818 - DNA, 116 bp, synthetic construct; identical to SEQ ID NO: 35524
  source 1..116: mol_type = other DNA

SEQ ID NO: 36819 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaataccgcggcccttctc

SEQ ID NO: 36820 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaatccctcggcccttctc

SEQ ID NO: 36821 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaatcccgcggcccttctc

SEQ ID NO: 36822 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacaatacctcgccccttctc

SEQ ID NO: 36823 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacgatacctcggcccttctc

SEQ ID NO: 36824 - DNA, 117 bp, synthetic construct; identical to SEQ ID NO: 35575
  source 1..117: mol_type = other DNA

SEQ ID NO: 36825 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaataccgcggcccttctca

SEQ ID NO: 36826 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaatccctcggcccttctca

SEQ ID NO: 36827 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaatcccgcggcccttctca

SEQ ID NO: 36828 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacaatacctcgccccttctca

SEQ ID NO: 36829 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacgatacctcggcccttctca

SEQ ID NO: 36830 - DNA, 120 bp, synthetic construct; identical to SEQ ID NO: 34761
  source 1..120: mol_type = other DNA

SEQ ID NO: 36831 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaataccgcggcccttctcag

SEQ ID NO: 36832 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaatccctcggcccttctcag

SEQ ID NO: 36833 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaatcccgcggcccttctcag

SEQ ID NO: 36834 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaatacctcgccccttctcag

SEQ ID NO: 36835 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacgatacctcggcccttctcag

SEQ ID NO: 36836 - DNA, 118 bp, synthetic construct; identical to SEQ ID NO: 35526
  source 1..118: mol_type = other DNA

SEQ ID NO: 36837 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaataccgcggcccttctc

SEQ ID NO: 36838 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaatccctcggcccttctc

SEQ ID NO: 36839 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaatcccgcggcccttctc

SEQ ID NO: 36840 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacaatacctcgccccttctc

SEQ ID NO: 36841 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcccacgatacctcggcccttctc

SEQ ID NO: 36842 - DNA, 119 bp, synthetic construct; identical to SEQ ID NO: 35577
  source 1..119: mol_type = other DNA

SEQ ID NO: 36843 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaataccgcggcccttctca

SEQ ID NO: 36844 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaatccctcggcccttctca

SEQ ID NO: 36845 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaatcccgcggcccttctca

SEQ ID NO: 36846 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacaatacctcgccccttctca

SEQ ID NO: 36847 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcccacgatacctcggcccttctca

SEQ ID NO: 36848 - DNA, 122 bp, synthetic construct; identical to SEQ ID NO: 34763
  source 1..122: mol_type = other DNA

SEQ ID NO: 36849 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaataccgcggcccttctcag

SEQ ID NO: 36850 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaatccctcggcccttctcag

SEQ ID NO: 36851 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaatcccgcggcccttctcag

SEQ ID NO: 36852 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaatacctcgccccttctcag

SEQ ID NO: 36853 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacgatacctcggcccttctcag

SEQ ID NO: 36854 - DNA, 120 bp, synthetic construct; identical to SEQ ID NO: 35528
  source 1..120: mol_type = other DNA

SEQ ID NO: 36855 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaataccgcggcccttctc

SEQ ID NO: 36856 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaatccctcggcccttctc

SEQ ID NO: 36857 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaatcccgcggcccttctc

SEQ ID NO: 36858 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacaatacctcgccccttctc

SEQ ID NO: 36859 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgccacgatacctcggcccttctc

SEQ ID NO: 36860 - DNA, 121 bp, synthetic construct; identical to SEQ ID NO: 35579
  source 1..121: mol_type = other DNA

SEQ ID NO: 36861 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaataccgcggcccttctca

SEQ ID NO: 36862 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaatccctcggcccttctca

SEQ ID NO: 36863 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaatcccgcggcccttctca

SEQ ID NO: 36864 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacaatacctcgccccttctca

SEQ ID NO: 36865 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgccacgatacctcggcccttctca

SEQ ID NO: 36866 - DNA, 124 bp, synthetic construct; identical to SEQ ID NO: 34765
  source 1..124: mol_type = other DNA

SEQ ID NO: 36867 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaataccgcggcccttctcag

SEQ ID NO: 36868 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaatccctcggcccttctcag

SEQ ID NO: 36869 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaatcccgcggcccttctcag

SEQ ID NO: 36870 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaatacctcgccccttctcag

SEQ ID NO: 36871 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacgatacctcggcccttctcag

SEQ ID NO: 36872 - DNA, 122 bp, synthetic construct; identical to SEQ ID NO: 35530
  source 1..122: mol_type = other DNA

SEQ ID NO: 36873 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaataccgcggcccttctc

SEQ ID NO: 36874 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaatccctcggcccttctc

SEQ ID NO: 36875 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaatcccgcggcccttctc

SEQ ID NO: 36876 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacaatacctcgccccttctc

SEQ ID NO: 36877 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgctgccacgatacctcggcccttctc

SEQ ID NO: 36878 - DNA, 123 bp, synthetic construct; identical to SEQ ID NO: 35581
  source 1..123: mol_type = other DNA

SEQ ID NO: 36879 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaataccgcggcccttctca

SEQ ID NO: 36880 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaatccctcggcccttctca

SEQ ID NO: 36881 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaatcccgcggcccttctca

SEQ ID NO: 36882 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacaatacctcgccccttctca

SEQ ID NO: 36883 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgctgccacgatacctcggcccttctca

SEQ ID NO: 36884 - DNA, 126 bp, synthetic construct; identical to SEQ ID NO: 34767
  source 1..126: mol_type = other DNA

SEQ ID NO: 36885 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaataccgcggcccttctcag

SEQ ID NO: 36886 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaatccctcggcccttctcag

SEQ ID NO: 36887 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaatcccgcggcccttctcag

SEQ ID NO: 36888 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaatacctcgccccttctcag

SEQ ID NO: 36889 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacgatacctcggcccttctcag

SEQ ID NO: 36890 - DNA, 124 bp, synthetic construct; identical to SEQ ID NO: 35532
  source 1..124: mol_type = other DNA

SEQ ID NO: 36891 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaataccgcggcccttctc

SEQ ID NO: 36892 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaatccctcggcccttctc

SEQ ID NO: 36893 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaatcccgcggcccttctc

SEQ ID NO: 36894 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacaatacctcgccccttctc

SEQ ID NO: 36895 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcttgctgccacgatacctcggcccttctc

SEQ ID NO: 36896 - DNA, 125 bp, synthetic construct; identical to SEQ ID NO: 35583
  source 1..125: mol_type = other DNA

SEQ ID NO: 36897 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaataccgcggcccttctca

SEQ ID NO: 36898 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaatccctcggcccttctca

SEQ ID NO: 36899 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaatcccgcggcccttctca

SEQ ID NO: 36900 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacaatacctcgccccttctca

SEQ ID NO: 36901 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttgctgccacgatacctcggcccttctca

SEQ ID NO: 36902 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcaagggacggggtattgtggca

SEQ ID NO: 36903 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcagaagggacggggtattgtggca

SEQ ID NO: 36904 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgctgagaagggacggggtattgtggca

SEQ ID NO: 36905 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcactgagaagggacggggtattgtggca

SEQ ID NO: 36906 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgaactgagaagggacggggtattgtggca

SEQ ID NO: 36907 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggca

SEQ ID NO: 36908 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggca

SEQ ID NO: 36909 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggca

SEQ ID NO: 36910 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcgggacggggtattgtggca

SEQ ID NO: 36911 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcaagggacggggtattgtggcag

SEQ ID NO: 36912 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcagaagggacggggtattgtggcag

SEQ ID NO: 36913 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgctgagaagggacggggtattgtggcag

SEQ ID NO: 36914 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcactgagaagggacggggtattgtggcag

SEQ ID NO: 36915 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcag

SEQ ID NO: 36916 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcag

SEQ ID NO: 36917 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcag

SEQ ID NO: 36918 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggcag

SEQ ID NO: 36919 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcgggacggggtattgtggcag

SEQ ID NO: 36920 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcaagggacggggtattgtggcagc

SEQ ID NO: 36921 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcagaagggacggggtattgtggcagc

SEQ ID NO: 36922 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgctgagaagggacggggtattgtggcagc

SEQ ID NO: 36923 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcactgagaagggacggggtattgtggcagc

SEQ ID NO: 36924 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcagc

SEQ ID NO: 36925 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcagc

SEQ ID NO: 36926 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcagc

SEQ ID NO: 36927 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggcagc

SEQ ID NO: 36928 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgggacggggtattgtggcagc

SEQ ID NO: 36929 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcaagggacggggtattgtggcagca

SEQ ID NO: 36930 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcagaagggacggggtattgtggcagca

SEQ ID NO: 36931 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgctgagaagggacggggtattgtggcagca

SEQ ID NO: 36932 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcactgagaagggacggggtattgtggcagca

SEQ ID NO: 36933 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcagca

SEQ ID NO: 36934 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcagca

SEQ ID NO: 36935 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcagca

SEQ ID NO: 36936 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggcagca

SEQ ID NO: 36937 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgggacggggtattgtggcagca

SEQ ID NO: 36938 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcaagggacggggtattgtggcagcaa

SEQ ID NO: 36939 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcagaagggacggggtattgtggcagcaa

SEQ ID NO: 36940 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgctgagaagggacggggtattgtggcagcaa

SEQ ID NO: 36941 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgcactgagaagggacggggtattgtggcagcaa

SEQ ID NO: 36942 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcagcaa

SEQ ID NO: 36943 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcagcaa

SEQ ID NO: 36944 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcagcaa

SEQ ID NO: 36945 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggcagcaa

SEQ ID NO: 36946 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgggacggggtattgtggcagcaa

SEQ ID NO: 36947 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcaagggacggggtattgtggcagcaaa

SEQ ID NO: 36948 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcagaagggacggggtattgtggcagcaaa

SEQ ID NO: 36949 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctgagaagggacggggtattgtggcagcaaa

SEQ ID NO: 36950 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgcactgagaagggacggggtattgtggcagcaaa

SEQ ID NO: 36951 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcagcaaa

SEQ ID NO: 36952 - DNA, 132 bp, synthetic construct
  source 1..132: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcagcaaa

SEQ ID NO: 36953 - DNA, 134 bp, synthetic construct
  source 1..134: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcagcaaa

SEQ ID NO: 36954 - DNA, 136 bp, synthetic construct
  source 1..136: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggcagcaaa

SEQ ID NO: 36955 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgggacggggtattgtggcagcaaa

SEQ ID NO: 36956 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaagggacggggtattgtggcagcaaag

SEQ ID NO: 36957 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcagaagggacggggtattgtggcagcaaag

SEQ ID NO: 36958 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctgagaagggacggggtattgtggcagcaaag

SEQ ID NO: 36959 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgcactgagaagggacggggtattgtggcagcaaag

SEQ ID NO: 36960 - DNA, 131 bp, synthetic construct
  source 1..131: mol_type = other DNA
actttgctgccacaatacctgttttagagctagaaatagcaagttaaaataaggctagtccgttatcaacttgaaaaagtggcaccgagtcggtgcgaactgagaagggacggggtattgtggcagcaaag

SEQ ID NO: 36961 - DNA, 133 bp, synthetic construct
  source 1..133: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggcagcaaag

SEQ ID NO: 36962 - DNA, 135 bp, synthetic construct
  source 1..135: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggcagcaaag

SEQ ID NO: 36963 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgggacggggtattgtggcagcaaag

SEQ ID NO: 36964 - DNA, 121 bp, synthetic construct; identical to SEQ ID NO: 36963
  source 1..121: mol_type = other DNA

SEQ ID NO: 36965 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcaagggacggggtattgtg

SEQ ID NO: 36966 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcagaagggacggggtattgtg

SEQ ID NO: 36967 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgctgagaagggacggggtattgtg

SEQ ID NO: 36968 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcactgagaagggacggggtattgtg

SEQ ID NO: 36969 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcgaactgagaagggacggggtattgtg

SEQ ID NO: 36970 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtg

SEQ ID NO: 36971 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtg

SEQ ID NO: 36972 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtg

SEQ ID NO: 36973 - DNA, 112 bp, synthetic construct
  source 1..112: mol_type = other DNA
actttgctgccacaatacctgttttagagctagaaatagcaagttaaaataaggctagtccgttatcaacttgaaaaagtggcaccgagtcggtgcgggacggggtattgtg

SEQ ID NO: 36974 - DNA, 115 bp, synthetic construct
  source 1..115: mol_type = other DNA
actttgctgccacaatacctgttttagagctagaaatagcaagttaaaataaggctagtccgttatcaacttgaaaaagtggcaccgagtcggtgcaagggacggggtattgtgg

SEQ ID NO: 36975 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcagaagggacggggtattgtgg

SEQ ID NO: 36976 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgctgagaagggacggggtattgtgg

SEQ ID NO: 36977 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcactgagaagggacggggtattgtgg

SEQ ID NO: 36978 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcgaactgagaagggacggggtattgtgg

SEQ ID NO: 36979 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtgg

SEQ ID NO: 36980 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtgg

SEQ ID NO: 36981 - DNA, 129 bp, synthetic construct
  source 1..129: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtgg

SEQ ID NO: 36982 - DNA, 113 bp, synthetic construct
  source 1..113: mol_type = other DNA
actttgctgccacaatacctgttttagagctagaaatagcaagttaaaataaggctagtccgttatcaacttgaaaaagtggcaccgagtcggtgcgggacggggtattgtgg

SEQ ID NO: 36983 - DNA, 116 bp, synthetic construct
  source 1..116: mol_type = other DNA
actttgctgccacaatacctgttttagagctagaaatagcaagttaaaataaggctagtccgttatcaacttgaaaaagtggcaccgagtcggtgcaagggacggggtattgtggc

SEQ ID NO: 36984 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcagaagggacggggtattgtggc

SEQ ID NO: 36985 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgctgagaagggacggggtattgtggc

SEQ ID NO: 36986 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcactgagaagggacggggtattgtggc

SEQ ID NO: 36987 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcgaactgagaagggacggggtattgtggc

SEQ ID NO: 36988 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgcgcgaactgagaagggacggggtattgtggc

SEQ ID NO: 36989 - DNA, 128 bp, synthetic construct
  source 1..128: mol_type = other DNA
actttgctgccacaatacctgttttagagctagaaatagcaagttaaaataaggctagtccgttatcaacttgaaaaagtggcaccgagtcggtgctagcgaactgagaagggacggggtattgtggc

SEQ ID NO: 36990 - DNA, 130 bp, synthetic construct
  source 1..130: mol_type = other DNA
actttgctgccacaatacctgttttagagctagaaatagcaagttaaaataaggctagtccgttatcaacttgaaaaagtggcaccgagtcggtgccgtagcgaactgagaagggacggggtattgtggc

SEQ ID NO: 36991 - DNA, 114 bp, synthetic construct
  source 1..114: mol_type = other DNA
actttgctgccacaatacctgttttagagctagaaatagcaagttaaaataaggctagtccgttatcaacttgaaaaagtggcaccgagtcggtgcgggacggggtattgtggc

SEQ ID NO: 36992 - DNA, 118 bp, synthetic construct; identical to SEQ ID NO: 35677
  source 1..118: mol_type = other DNA

SEQ ID NO: 36993 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaagggccggggtattgtggca

SEQ ID NO: 36994 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaacggccggggtattgtggca

SEQ ID NO: 36995 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaacggacggggtattgtggca

SEQ ID NO: 36996 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaagggccgcggtattgtggca

SEQ ID NO: 36997 - DNA, 118 bp, synthetic construct
  source 1..118: mol_type = other DNA
actttgctgccacaatacctgttttagagctagaaatagcaagttaaaataaggctagtccgttatcaacttgaaaaagtggcaccgagtcggtgcgaagggacgcggtattgtggca

SEQ ID NO: 36998 - DNA, 119 bp, synthetic construct; identical to SEQ ID NO: 35728
  source 1..119: mol_type = other DNA

SEQ ID NO: 36999 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaagggccggggtattgtggcag

SEQ ID NO: 37000 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaacggccggggtattgtggcag

SEQ ID NO: 37001 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaacggacggggtattgtggcag

SEQ ID NO: 37002 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaagggccgcggtattgtggcag

SEQ ID NO: 37003 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgaagggacgcggtattgtggcag

SEQ ID NO: 37004 - DNA, 117 bp, synthetic construct; identical to SEQ ID NO: 36493
  source 1..117: mol_type = other DNA

SEQ ID NO: 37005 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaagggccggggtattgtggc

SEQ ID NO: 37006 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaacggccggggtattgtggc

SEQ ID NO: 37007 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaacggacggggtattgtggc

SEQ ID NO: 37008 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaagggccgcggtattgtggc

SEQ ID NO: 37009 - DNA, 117 bp, synthetic construct
  source 1..117: mol_type = other DNA
actttgctgccacaatacctgttttagagctagaaatagcaagttaaaataaggctagtccgttatcaacttgaaaaagtggcaccgagtcggtgcgaagggacgcggtattgtggc

SEQ ID NO: 37010 - DNA, 120 bp, synthetic construct; identical to SEQ ID NO: 35679
  source 1..120: mol_type = other DNA

SEQ ID NO: 37011 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaagggccggggtattgtggca

SEQ ID NO: 37012 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaacggccggggtattgtggca

SEQ ID NO: 37013 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaacggacggggtattgtggca

SEQ ID NO: 37014 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaagggccgcggtattgtggca

SEQ ID NO: 37015 - DNA, 120 bp, synthetic construct
  source 1..120: mol_type = other DNA
actttgctgccacaatacctgttttagagctagaaatagcaagttaaaataaggctagtccgttatcaacttgaaaaagtggcaccgagtcggtgcgagaagggacgcggtattgtggca

SEQ ID NO: 37016 - DNA, 121 bp, synthetic construct; identical to SEQ ID NO: 35730
  source 1..121: mol_type = other DNA

SEQ ID NO: 37017 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaagggccggggtattgtggcag

SEQ ID NO: 37018 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaacggccggggtattgtggcag

SEQ ID NO: 37019 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaacggacggggtattgtggcag

SEQ ID NO: 37020 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaagggccgcggtattgtggcag

SEQ ID NO: 37021 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcgagaagggacgcggtattgtggcag

SEQ ID NO: 37022 - DNA, 119 bp, synthetic construct; identical to SEQ ID NO: 36495
  source 1..119: mol_type = other DNA

SEQ ID NO: 37023 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaagggccggggtattgtggc

SEQ ID NO: 37024 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaacggccggggtattgtggc

SEQ ID NO: 37025 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaacggacggggtattgtggc

SEQ ID NO: 37026 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaagggccgcggtattgtggc

SEQ ID NO: 37027 - DNA, 119 bp, synthetic construct
  source 1..119: mol_type = other DNA
actttgctgccacaatacctgttttagagctagaaatagcaagttaaaataaggctagtccgttatcaacttgaaaaagtggcaccgagtcggtgcgagaagggacgcggtattgtggc

SEQ ID NO: 37028 - DNA, 122 bp, synthetic construct; identical to SEQ ID NO: 35681
  source 1..122: mol_type = other DNA

SEQ ID NO: 37029 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaagggccggggtattgtggca

SEQ ID NO: 37030 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaacggccggggtattgtggca

SEQ ID NO: 37031 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaacggacggggtattgtggca

SEQ ID NO: 37032 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaagggccgcggtattgtggca

SEQ ID NO: 37033 - DNA, 122 bp, synthetic construct
  source 1..122: mol_type = other DNA
actttgctgccacaatacctgttttagagctagaaatagcaagttaaaataaggctagtccgttatcaacttgaaaaagtggcaccgagtcggtgcctgagaagggacgcggtattgtggca

SEQ ID NO: 37034 - DNA, 123 bp, synthetic construct; identical to SEQ ID NO: 35732
  source 1..123: mol_type = other DNA

SEQ ID NO: 37035 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaagggccggggtattgtggcag

SEQ ID NO: 37036 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaacggccggggtattgtggcag

SEQ ID NO: 37037 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaacggacggggtattgtggcag

SEQ ID NO: 37038 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaagggccgcggtattgtggcag

SEQ ID NO: 37039 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcctgagaagggacgcggtattgtggcag

SEQ ID NO: 37040 - DNA, 121 bp, synthetic construct; identical to SEQ ID NO: 36497
  source 1..121: mol_type = other DNA

SEQ ID NO: 37041 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaagggccggggtattgtggc

SEQ ID NO: 37042 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaacggccggggtattgtggc

SEQ ID NO: 37043 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaacggacggggtattgtggc

SEQ ID NO: 37044 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaagggccgcggtattgtggc

SEQ ID NO: 37045 - DNA, 121 bp, synthetic construct
  source 1..121: mol_type = other DNA
actttgctgccacaatacctgttttagagctagaaatagcaagttaaaataaggctagtccgttatcaacttgaaaaagtggcaccgagtcggtgcctgagaagggacgcggtattgtggc

SEQ ID NO: 37046 - DNA, 124 bp, synthetic construct; identical to SEQ ID NO: 35683
  source 1..124: mol_type = other DNA

SEQ ID NO: 37047 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaagggccggggtattgtggca

SEQ ID NO: 37048 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaacggccggggtattgtggca

SEQ ID NO: 37049 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaacggacggggtattgtggca

SEQ ID NO: 37050 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaagggccgcggtattgtggca

SEQ ID NO: 37051 - DNA, 124 bp, synthetic construct
  source 1..124: mol_type = other DNA
actttgctgccacaatacctgttttagagctagaaatagcaagttaaaataaggctagtccgttatcaacttgaaaaagtggcaccgagtcggtgcaactgagaagggacgcggtattgtggca

SEQ ID NO: 37052 - DNA, 125 bp, synthetic construct; identical to SEQ ID NO: 35734
  source 1..125: mol_type = other DNA

SEQ ID NO: 37053 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaagggccggggtattgtggcag

SEQ ID NO: 37054 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaacggccggggtattgtggcag

SEQ ID NO: 37055 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaacggacggggtattgtggcag

SEQ ID NO: 37056 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaagggccgcggtattgtggcag

SEQ ID NO: 37057 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgcaactgagaagggacgcggtattgtggcag

SEQ ID NO: 37058 - DNA, 123 bp, synthetic construct; identical to SEQ ID NO: 36499
  source 1..123: mol_type = other DNA

SEQ ID NO: 37059 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaagggccggggtattgtggc

SEQ ID NO: 37060 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaacggccggggtattgtggc

SEQ ID NO: 37061 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaacggacggggtattgtggc

SEQ ID NO: 37062 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaagggccgcggtattgtggc

SEQ ID NO: 37063 - DNA, 123 bp, synthetic construct
  source 1..123: mol_type = other DNA
actttgctgccacaatacctgttttagagctagaaatagcaagttaaaataaggctagtccgttatcaacttgaaaaagtggcaccgagtcggtgcaactgagaagggacgcggtattgtggc

SEQ ID NO: 37064 - DNA, 126 bp, synthetic construct; identical to SEQ ID NO: 35685
  source 1..126: mol_type = other DNA

SEQ ID NO: 37065 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaagggccggggtattgtggca

SEQ ID NO: 37066 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaacggccggggtattgtggca

SEQ ID NO: 37067 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaacggacggggtattgtggca

SEQ ID NO: 37068 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaagggccgcggtattgtggca

SEQ ID NO: 37069 - DNA, 126 bp, synthetic construct
  source 1..126: mol_type = other DNA
actttgctgccacaatacctgttttagagctagaaatagcaagttaaaataaggctagtccgttatcaacttgaaaaagtggcaccgagtcggtgccgaactgagaagggacgcggtattgtggca

SEQ ID NO: 37070 - DNA, 127 bp, synthetic construct; identical to SEQ ID NO: 35736
  source 1..127: mol_type = other DNA

SEQ ID NO: 37071 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaagggccggggtattgtggcag

SEQ ID NO: 37072 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaacggccggggtattgtggcag

SEQ ID NO: 37073 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaacggacggggtattgtggcag

SEQ ID NO: 37074 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaagggccgcggtattgtggcag

SEQ ID NO: 37075 - DNA, 127 bp, synthetic construct
  source 1..127: mol_type = other DNA
actttgctgccacaatacctgttttagagctagaaatagcaagttaaaataaggctagtccgttatcaacttgaaaaagtggcaccgagtcggtgccgaactgagaagggacgcggtattgtggcag

SEQ ID NO: 37076 - DNA, 125 bp, synthetic construct; identical to SEQ ID NO: 36501
  source 1..125: mol_type = other DNA

SEQ ID NO: 37077 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaagggccggggtattgtggc

SEQ ID NO: 37078 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaacggccggggtattgtggc

SEQ ID NO: 37079 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaacggacggggtattgtggc

SEQ ID NO: 37080 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaagggccgcggtattgtggc

SEQ ID NO: 37081 - DNA, 125 bp, synthetic construct
  source 1..125: mol_type = other DNA
actttgctgccacaatacctgttttagagctagaaatagcaagttaaaataaggctagtccgttatcaacttgaaaaagtggcaccgagtcggtgccgaactgagaagggacgcggtattgtggc

SEQ ID NO: 37082 - DNA, 20 bp, synthetic construct
  source 1..20: mol_type = other DNA
ttacttcttttttaggaaca

SEQ ID NO: 37083 - DNA, 20 bp, synthetic construct
  source 1..20: mol_type = other DNA
tggcattttacttctttttt

SEQ ID NO: 37084 - DNA, 20 bp, synthetic construct
  source 1..20: mol_type = other DNA
agtcttaagagagttctcag

SEQ ID NO: 37085 - DNA, 20 bp, synthetic construct
  source 1..20: mol_type = other DNA
gaagggcaccatttggagaa

SEQ ID NO: 37086 - DNA, 20 bp, synthetic construct
  source 1..20: mol_type = other DNA
cttgagtgaagggcaccatt

SEQ ID NO: 37087 - DNA, 20 bp, synthetic construct
  source 1..20: mol_type = other DNA
taagactacctttctccaaa

SEQ ID NO: 37088 - DNA, 20 bp, synthetic construct
  source 1..20: mol_type = other DNA
aaaccacaggcttgagtgaa

SEQ ID NO: 37089 - DNA, 20 bp, synthetic construct
  source 1..20: mol_type = other DNA
aaaaccacaggcttgagtga

SEQ ID NO: 37090 - DNA, 20 bp, synthetic construct
  source 1..20: mol_type = other DNA
gttcctaagaccaaaaccac

SEQ ID NO: 37091 - DNA, 20 bp, synthetic construct
  source 1..20: mol_type = other DNA
gtgcccttcactcaagcctg

SEQ ID NO: 37092 - DNA, 20 bp, synthetic construct
  source 1..20: mol_type = other DNA
ttcactcaagcctgtggttt

SEQ ID NO: 37093 - DNA, 20 bp, synthetic construct
  source 1..20: mol_type = other DNA
aagcctgtggttttggtctt

SEQ ID NO: 37094 - DNA, 20 bp, synthetic construct
  source 1..20: mol_type = other DNA
gtccaagacctcaatccttt

SEQ ID NO: 37095 - DNA, 20 bp, synthetic construct
  source 1..20: mol_type = other DNA
tgtccaagacctcaatcctt

SEQ ID NO: 37096 - DNA, 20 bp, synthetic construct
  source 1..20: mol_type = other DNA
gctacgacccatacacccaa

SEQ ID NO: 37097 - DNA, 20 bp, synthetic construct
  source 1..20: mol_type = other DNA
cccatacacccaaaggattg

SEQ ID NO: 37098 - DNA, 20 bp, synthetic construct
  source 1..20: mol_type = other DNA
cacccaaaggattgaggtct

SEQ ID NO: 37099 - DNA, 20 bp, synthetic construct
  source 1..20: mol_type = other DNA
agccaaaatcttaagctgct

SEQ ID NO: 37100 - DNA, 20 bp, synthetic construct
  source 1..20: mol_type = other DNA
cagccaaaatcttaagctgc

SEQ ID NO: 37101 - DNA, 20 bp, synthetic construct
  source 1..20: mol_type = other DNA
tacccagcagcttaagattt

SEQ ID NO: 37102 - DNA, 20 bp, synthetic construct
  source 1..20: mol_type = other DNA
tgtaaattacttactgttaa

SEQ ID NO: 37103 - DNA, 20 bp, synthetic construct
  source 1..20: mol_type = other DNA
agaaaccgagtggcctcgta

SEQ ID NO: 37104 - DNA, 20 bp, synthetic construct
  source 1..20: mol_type = other DNA
taagtaatttacaccttacg

SEQ ID NO: 37105 - DNA, 20 bp, synthetic construct
  source 1..20: mol_type = other DNA
tcgattactgagaaaccgag

SEQ ID NO: 37106 - DNA, 20 bp, synthetic construct
  source 1..20: mol_type = other DNA
ttacaccttacgaggccact

SEQ ID NO: 37107 - DNA, 20 bp, synthetic construct
  source 1..20: mol_type = other DNA
tttttcctatggcgatggta

SEQ ID NO: 37108 - DNA, 20 bp, synthetic construct
  source 1..20: mol_type = other DNA
atttttcctatggcgatggt

SEQ ID NO: 37109 - DNA, 20 bp, synthetic construct
  source 1..20: mol_type = other DNA
tattatttttcctatggcga

SEQ ID NO: 37110 - DNA, 20 bp, synthetic construct
  source 1..20: mol_type = other DNA
taaatttattatttttccta

SEQ ID NO: 37111 - DNA, 20 bp, synthetic construct
  source 1..20: mol_type = other DNA
tctttccctaccatcgccat

SEQ ID NO: 37112 - DNA, 20 bp, synthetic construct
  source 1..20: mol_type = other DNA
tttattgaaatatttaatta

SEQ ID NO: 37113 - DNA, 20 bp, synthetic construct
  source 1..20: mol_type = other DNA
tgagaagggccgaggtattg

SEQ ID NO: 37114 - DNA, 20 bp, synthetic construct
  source 1..20: mol_type = other DNA
tagcgaactgagaagggcca

SEQ ID NO: 37115 - DNA, 20 bp, synthetic construct
  source 1..20: mol_type = other DNA
tagcgaactgagaagggccg

SEQ ID NO: 37116 - DNA, 20 bp, synthetic construct
  source 1..20: mol_type = other DNA
tgagaagggccaaggtattg

SEQ ID NO: 37117 - DNA, 20 bp, synthetic construct
  source 1..20: mol_type = other DNA
tagcgaactgagaagggcca

SEQ ID NO: 37118 - DNA, 20 bp, synthetic construct
  source 1..20: mol_type = other DNA
tagcgaactgagaagggccg

SEQ ID NO: 37119 - DNA, 20 bp, synthetic construct
  source 1..20: mol_type = other DNA
actttgctgccacaatacct

SEQ ID NO: 37120 - DNA, 20 bp, synthetic construct
  source 1..20: mol_type = other DNA
gggtcgtagcgaactgagaa

SEQ ID NO: 37121 - DNA, 20 bp, synthetic construct
  source 1..20: mol_type = other DNA
tgggtcgtagcgaactgaga

SEQ ID NO: 37122 - DNA, 20 bp, synthetic construct
  source 1..20: mol_type = other DNA
cctcaatcctttgggtgtat

SEQ ID NO: 37123 - DNA, 20 bp, synthetic construct
  source 1..20: mol_type = other DNA
acctcaatcctttgggtgta

SEQ ID NO: 37124 - DNA, 100 bp, synthetic construct
  source 1..100: mol_type = other DNA
ttacttcttttttaggaacagttttagagctagaaatagcaagttaaaataaggctagtccgttatcaacttgaaaaagtggcaccgagtcggtgctttt

SEQ ID NO: 37125 - DNA, 100 bp, synthetic construct
  source 1..100: mol_type = other DNA
tggcattttacttcttttttgttttagagctagaaatagcaagttaaaataaggctagtccgttatcaacttgaaaaagtggcaccgagtcggtgctttt

SEQ ID NO: 37126 - DNA, 100 bp, synthetic construct
  source 1..100: mol_type = other DNA
agtcttaagagagttctcaggttttagagctagaaatagcaagttaaaataaggctagtccgttatcaacttgaaaaagtggcaccgagtcggtgctttt

SEQ ID NO: 37127 - DNA, 100 bp, synthetic construct
  source 1..100: mol_type = other DNA
gaagggcaccatttggagaagttttagagctagaaatagcaagttaaaataaggctagtccgttatcaacttgaaaaagtggcaccgagtcggtgctttt

SEQ ID NO: 37128 - DNA, 100 bp, synthetic construct
  source 1..100: mol_type = other DNA
cttgagtgaagggcaccattgttttagagctagaaatagcaagttaaaataaggctagtccgttatcaacttgaaaaagtggcaccgagtcggtgctttt

SEQ ID NO: 37129 - DNA, 100 bp, synthetic construct
  source 1..100: mol_type = other DNA
taagactacctttctccaaagttttagagctagaaatagcaagttaaaataaggctagtccgttatcaacttgaaaaagtggcaccgagtcggtgctttt

SEQ ID NO: 37130 - DNA, 100 bp, synthetic construct
  source 1..100: mol_type = other DNA
aaaccacaggcttgagtgaagttttagagctagaaatagcaagttaaaataaggctagtccgttatcaacttgaaaaagtggcaccgagtcggtgctttt

SEQ ID NO: 37131 - DNA, 100 bp, synthetic construct
  source 1..100: mol_type = other DNA
aaaaccacaggcttgagtgagttttagagctagaaatagcaagttaaaataaggctagtccgttatcaacttgaaaaagtggcaccgagtcggtgctttt

SEQ ID NO: 37132 - DNA, 100 bp, synthetic construct
  source 1..100: mol_type = other DNA
gttcctaagaccaaaaccacgttttagagctagaaatagcaagttaaaataaggctagtccgttatcaacttgaaaaagtggcaccgagtcggtgctttt

SEQ ID NO: 37133 - DNA, 100 bp, synthetic construct
  source 1..100: mol_type = other DNA
gtgcccttcactcaagcctggttttagagctagaaatagcaagttaaaataaggctagtccgttatcaacttgaaaaagtggcaccgagtcggtgctttt

SEQ ID NO: 37134 - DNA, 100 bp, synthetic construct
  source 1..100: mol_type = other DNA
ttcactcaagcctgtggtttgttttagagctagaaatagcaagttaaaataaggctagtccgttatcaacttgaaaaagtggcaccgagtcggtgctttt

SEQ ID NO: 37135 - DNA, 100 bp, synthetic construct
  source 1..100: mol_type = other DNA
aagcctgtggttttggtcttgttttagagctagaaatagcaagttaaaataaggctagtccgttatcaacttgaaaaagtggcaccgagtcggtgctttt

SEQ ID NO: 37136 - DNA, 100 bp, synthetic construct
  source 1..100: mol_type = other DNA
gtccaagacctcaatcctttgttttagagctagaaatagcaagttaaaataaggctagtccgttatcaacttgaaaaagtggcaccgagtcggtgctttt

SEQ ID NO: 37137 - DNA, 100 bp, synthetic construct
  source 1..100: mol_type = other DNA
tgtccaagacctcaatccttgttttagagctagaaatagcaagttaaaataaggctagtccgttatcaacttgaaaaagtggcaccgagtcggtgctttt

SEQ ID NO: 37138 - DNA, 100 bp, synthetic construct
  source 1..100: mol_type = other DNA
gctacgacccatacacccaagttttagagctagaaatagcaagttaaaataaggctagtccgttatcaacttgaaaaagtggcaccgagtcggtgctttt

SEQ ID NO: 37139 - DNA, 100 bp, synthetic construct
  source 1..100: mol_type = other DNA
cccatacacccaaaggattggttttagagctagaaatagcaagttaaaataaggctagtccgttatcaacttgaaaaagtggcaccgagtcggtgctttt

SEQ ID NO: 37140 - DNA, 100 bp, synthetic construct
  source 1..100: mol_type = other DNA
cacccaaaggattgaggtctgttttagagctagaaatagcaagttaaaataaggctagtccgttatcaacttgaaaaagtggcaccgagtcggtgctttt

SEQ ID NO: 37141 - DNA, 100 bp, synthetic construct
  source 1..100: mol_type = other DNA
agccaaaatcttaagctgctgttttagagctagaaatagcaagttaaaataaggctagtccgttatcaacttgaaaaagtggcaccgagtcggtgctttt

SEQ ID NO: 37142 - DNA, 100 bp, synthetic construct
  source 1..100: mol_type = other DNA
cagccaaaatcttaagctgcgttttagagctagaaatagcaagttaaaataaggctagtccgttatcaacttgaaaaagtggcaccgagtcggtgctttt

SEQ ID NO: 37143 - DNA, 100 bp, synthetic construct
  source 1..100: mol_type = other DNA
tacccagcagcttaagatttgttttagagctagaaatagcaagttaaaataaggctagtccgttatcaacttgaaaaagtggcaccgagtcggtgctttt

SEQ ID NO: 37144 - DNA, 100 bp, synthetic construct
  source 1..100: mol_type = other DNA
tgtaaattacttactgttaagttttagagctagaaatagcaagttaaaataaggctagtccgttatcaacttgaaaaagtggcaccgagtcggtgctttt

SEQ ID NO: 37145 - DNA, 100 bp, synthetic construct
  source 1..100: mol_type = other DNA
agaaaccgagtggcctcgtagttttagagctagaaatagcaagttaaaataaggctagtccgttatcaacttgaaaaagtggcaccgagtcggtgctttt

SEQ ID NO: 37146 - DNA, 100 bp, synthetic construct
  source 1..100: mol_type = other DNA
taagtaatttacaccttacggttttagagctagaaatagcaagttaaaataaggctagtccgttatcaacttgaaaaagtggcaccgagtcggtgctttt

SEQ ID NO: 37147 - DNA, 100 bp, synthetic construct
  source 1..100: mol_type = other DNA
tcgattactgagaaaccgaggttttagagctagaaatagcaagttaaaataaggctagtccgttatcaacttgaaaaagtggcaccgagtcggtgctttt

SEQ ID NO: 37148 - DNA, 100 bp, synthetic construct
  source 1..100: mol_type = other DNA
ttacaccttacgaggccactgttttagagctagaaatagcaagttaaaataaggctagtccgttatcaacttgaaaaagtggcaccgagtcggtgctttt

SEQ ID NO: 37149 - DNA, 100 bp, synthetic construct
  source 1..100: mol_type = other DNA
tttttcctatggcgatggtagttttagagctagaaatagcaagttaaaataaggctagtccgttatcaacttgaaaaagtggcaccgagtcggtgctttt

SEQ ID NO: 37150 - DNA, 100 bp, synthetic construct
  source 1..100: mol_type = other DNA
atttttcctatggcgatggtgttttagagctagaaatagcaagttaaaataaggctagtccgttatcaacttgaaaaagtggcaccgagtcggtgctttt

SEQ ID NO: 37151 - DNA, 100 bp, synthetic construct
  source 1..100: mol_type = other DNA
tattatttttcctatggcgagttttagagctagaaatagcaagttaaaataaggctagtccgttatcaacttgaaaaagtggcaccgagtcggtgctttt

SEQ ID NO: 37152 - DNA, 100 bp, synthetic construct
  source 1..100: mol_type = other DNA
taaatttattatttttcctagttttagagctagaaatagcaagttaaaataaggctagtccgttatcaacttgaaaaagtggcaccgagtcggtgctttt

SEQ ID NO: 37153 - DNA, 100 bp, synthetic construct
  source 1..100: mol_type = other DNA
tctttccctaccatcgccatgttttagagctagaaatagcaagttaaaataaggctagtccgttatcaacttgaaaaagtggcaccgagtcggtgctttt

SEQ ID NO: 37154 - DNA, 100 bp, synthetic construct
  source 1..100: mol_type = other DNA
tttattgaaatatttaattagttttagagctagaaatagcaagttaaaataaggctagtccgttatcaacttgaaaaagtggcaccgagtcggtgctttt

SEQ ID NO: 37155 - DNA, 100 bp, synthetic construct
  source 1..100: mol_type = other DNA
tgagaagggccgaggtattggttttagagctagaaatagcaagttaaaataaggctagtccgttatcaacttgaaaaagtggcaccgagtcggtgctttt

SEQ ID NO: 37156 - DNA, 100 bp, synthetic construct
  source 1..100: mol_type = other DNA
tagcgaactgagaagggccggttttagagctagaaatagcaagttaaaataaggctagtccgttatcaacttgaaaaagtggcaccgagtcggtgctttt

SEQ ID NO: 37157 - DNA, 100 bp, synthetic construct; identical to SEQ ID NO: 37156
  source 1..100: mol_type = other DNA

SEQ ID NO: 37158 - DNA, 100 bp, synthetic construct
  source 1..100: mol_type = other DNA
tgagaagggccaaggtattggttttagagctagaaatagcaagttaaaataaggctagtccgttatcaacttgaaaaagtggcaccgagtcggtgctttt

SEQ ID NO: 37159 - DNA, 100 bp, synthetic construct
  source 1..100: mol_type = other DNA
tagcgaactgagaagggccagttttagagctagaaatagcaagttaaaataaggctagtccgttatcaacttgaaaaagtggcaccgagtcggtgctttt

SEQ ID NO: 37160 - DNA, 100 bp, synthetic construct; identical to SEQ ID NO: 37159
  source 1..100: mol_type = other DNA

SEQ ID NO: 37161 - DNA, 100 bp, synthetic construct
  source 1..100: mol_type = other DNA
actttgctgccacaatacctgttttagagctagaaatagcaagttaaaataaggctagtccgttatcaacttgaaaaagtggcaccgagtcggtgctttt

SEQ ID NO: 37162 - DNA, 100 bp, synthetic construct
  source 1..100: mol_type = other DNA
gggtcgtagcgaactgagaagttttagagctagaaatagcaagttaaaataaggctagtccgttatcaacttgaaaaagtggcaccgagtcggtgctttt

SEQ ID NO: 37163 - DNA, 100 bp, synthetic construct
  source 1..100: mol_type = other DNA
tgggtcgtagcgaactgagagttttagagctagaaatagcaagttaaaataaggctagtccgttatcaacttgaaaaagtggcaccgagtcggtgctttt

SEQ ID NO: 37164 - DNA, 100 bp, synthetic construct
  source 1..100: mol_type = other DNA
cctcaatcctttgggtgtatgttttagagctagaaatagcaagttaaaataaggctagtccgttatcaacttgaaaaagtggcaccgagtcggtgctttt

SEQ ID NO: 37165 - DNA, 100 bp, synthetic construct
  source 1..100: mol_type = other DNA
acctcaatcctttgggtgtagttttagagctagaaatagcaagttaaaataaggctagtccgttatcaacttgaaaaagtggcaccgagtcggtgctttt

SEQ ID NO: 37166 - RNA, 124 nt, synthetic construct; identical to SEQ ID NO: 30437
  source 1..124: mol_type = other RNA

SEQ ID NO: 37167 - RNA, 133 nt, synthetic construct; identical to SEQ ID NO: 30438
  source 1..133: mol_type = other RNA

SEQ ID NO: 37168 - RNA, 121 nt, synthetic construct; identical to SEQ ID NO: 30439
  source 1..121: mol_type = other RNA

SEQ ID NO: 37169 - RNA, 125 nt, synthetic construct; identical to SEQ ID NO: 30440
  source 1..125: mol_type = other RNA

SEQ ID NO: 37170 - RNA, 126 nt, synthetic construct; identical to SEQ ID NO: 30441
  source 1..126: mol_type = other RNA

SEQ ID NO: 37171 - RNA, 125 nt, synthetic construct; identical to SEQ ID NO: 30442
  source 1..125: mol_type = other RNA

SEQ ID NO: 37172 - RNA, 122 nt, synthetic construct; identical to SEQ ID NO: 30443
  source 1..122: mol_type = other RNA

SEQ ID NO: 37173 - RNA, 123 nt, synthetic construct; identical to SEQ ID NO: 30444
  source 1..123: mol_type = other RNA

SEQ ID NO: 37174 - RNA, 115 nt, synthetic construct; identical to SEQ ID NO: 30445
  source 1..115: mol_type = other RNA

SEQ ID NO: 37175 - RNA, 121 nt, synthetic construct; identical to SEQ ID NO: 30446
  source 1..121: mol_type = other RNA

SEQ ID NO: 37176 - RNA, 127 nt, synthetic construct; identical to SEQ ID NO: 30447
  source 1..127: mol_type = other RNA

SEQ ID NO: 37177 - RNA, 119 nt, synthetic construct; identical to SEQ ID NO: 30448
  source 1..119: mol_type = other RNA

SEQ ID NO: 37178 - RNA, 120 nt, synthetic construct; identical to SEQ ID NO: 30449
  source 1..120: mol_type = other RNA

SEQ ID NO: 37179 - RNA, 119 nt, synthetic construct; identical to SEQ ID NO: 30450
  source 1..119: mol_type = other RNA

SEQ ID NO: 37180 - RNA, 118 nt, synthetic construct; identical to SEQ ID NO: 30451
  source 1..118: mol_type = other RNA

SEQ ID NO: 37181 - RNA, 125 nt, synthetic construct; identical to SEQ ID NO: 30452
  source 1..125: mol_type = other RNA

SEQ ID NO: 37182 - RNA, 123 nt, synthetic construct; identical to SEQ ID NO: 30453
  source 1..123: mol_type = other RNA

SEQ ID NO: 37183 - RNA, 125 nt, synthetic construct; identical to SEQ ID NO: 30454
  source 1..125: mol_type = other RNA

SEQ ID NO: 37184 - RNA, 119 nt, synthetic construct; identical to SEQ ID NO: 30455
  source 1..119: mol_type = other RNA

SEQ ID NO: 37185 - RNA, 128 nt, synthetic construct; identical to SEQ ID NO: 30456
  source 1..128: mol_type = other RNA

SEQ ID NO: 37186 - RNA, 124 nt, synthetic construct; identical to SEQ ID NO: 30437
  source 1..124: mol_type = other RNA

SEQ ID NO: 37187 - RNA, 133 nt, synthetic construct; identical to SEQ ID NO: 30438
  source 1..133: mol_type = other RNA

SEQ ID NO: 37188 - RNA, 121 nt, synthetic construct; identical to SEQ ID NO: 30439
  source 1..121: mol_type = other RNA

SEQ ID NO: 37189 - RNA, 125 nt, synthetic construct; identical to SEQ ID NO: 30440
  source 1..125: mol_type = other RNA

SEQ ID NO: 37190 - RNA, 126 nt, synthetic construct; identical to SEQ ID NO: 30441
  source 1..126: mol_type = other RNA

SEQ ID NO: 37191 - RNA, 125 nt, synthetic construct; identical to SEQ ID NO: 30442
  source 1..125: mol_type = other RNA

SEQ ID NO: 37192 - RNA, 122 nt, synthetic construct; identical to SEQ ID NO: 30443
  source 1..122: mol_type = other RNA

SEQ ID NO: 37193 - RNA, 123 nt, synthetic construct; identical to SEQ ID NO: 30444
  source 1..123: mol_type = other RNA

SEQ ID NO: 37194 - RNA, 115 nt, synthetic construct; identical to SEQ ID NO: 30445
  source 1..115: mol_type = other RNA

SEQ ID NO: 37195 - RNA, 121 nt, synthetic construct; identical to SEQ ID NO: 30446
  source 1..121: mol_type = other RNA

SEQ ID NO: 37196 - RNA, 127 nt, synthetic construct; identical to SEQ ID NO: 30447
  source 1..127: mol_type = other RNA

SEQ ID NO: 37197 - RNA, 119 nt, synthetic construct; identical to SEQ ID NO: 30448
  source 1..119: mol_type = other RNA

SEQ ID NO: 37198 - RNA, 120 nt, synthetic construct; identical to SEQ ID NO: 30449
  source 1..120: mol_type = other RNA

SEQ ID NO: 37199 - RNA, 119 nt, synthetic construct; identical to SEQ ID NO: 30450
  source 1..119: mol_type = other RNA

SEQ ID NO: 37200 - RNA, 118 nt, synthetic construct; identical to SEQ ID NO: 30451
  source 1..118: mol_type = other RNA

SEQ ID NO: 37201 - RNA, 125 nt, synthetic construct; identical to SEQ ID NO: 30452
  source 1..125: mol_type = other RNA

SEQ ID NO: 37202 - RNA, 123 nt, synthetic construct; identical to SEQ ID NO: 30453
  source 1..123: mol_type = other RNA

SEQ ID NO: 37203 - RNA, 125 nt, synthetic construct; identical to SEQ ID NO: 30454
  source 1..125: mol_type = other RNA

SEQ ID NO: 37204 - RNA, 119 nt, synthetic construct; identical to SEQ ID NO: 30455
  source 1..119: mol_type = other RNA

SEQ ID NO: 37205 - RNA, 128 nt, synthetic construct; identical to SEQ ID NO: 30456
  source 1..128: mol_type = other RNA

SEQ ID NO: 37206 - RNA, 122 nt, synthetic construct; identical to SEQ ID NO: 30485
  source 1..122: mol_type = other RNA

SEQ ID NO: 37207 - RNA, 124 nt, synthetic construct; identical to SEQ ID NO: 30486
  source 1..124: mol_type = other RNA

SEQ ID NO: 37208 - RNA, 121 nt, synthetic construct; identical to SEQ ID NO: 30487
  source 1..121: mol_type = other RNA

SEQ ID NO: 37209 - RNA, 122 nt, synthetic construct; identical to SEQ ID NO: 30488
  source 1..122: mol_type = other RNA

SEQ ID NO: 37210 - RNA, 115 nt, synthetic construct; identical to SEQ ID NO: 30489
  source 1..115: mol_type = other RNA

SEQ ID NO: 37211 - RNA, 116 nt, synthetic construct; identical to SEQ ID NO: 30490
  source 1..116: mol_type = other RNA

SEQ ID NO: 37212 - RNA, 117 nt, synthetic construct; identical to SEQ ID NO: 30491
  source 1..117: mol_type = other RNA

SEQ ID NO: 37213 - RNA, 118 nt, synthetic construct; identical to SEQ ID NO: 30492
  source 1..118: mol_type = other RNA

SEQ ID NO: 37214 - RNA, 119 nt, synthetic construct; identical to SEQ ID NO: 30493
  source 1..119: mol_type = other RNA

SEQ ID NO: 37215 - RNA, 122 nt, synthetic construct; identical to SEQ ID NO: 30494
  source 1..122: mol_type = other RNA

SEQ ID NO: 37216 - RNA, 124 nt, synthetic construct; identical to SEQ ID NO: 30495
  source 1..124: mol_type = other RNA

SEQ ID NO: 37217 - RNA, 121 nt, synthetic construct; identical to SEQ ID NO: 30496
  source 1..121: mol_type = other RNA

SEQ ID NO: 37218 - RNA, 123 nt, synthetic construct; identical to SEQ ID NO: 30497
  source 1..123: mol_type = other RNA

SEQ ID NO: 37219 - RNA, 127 nt, synthetic construct; identical to SEQ ID NO: 30498
  source 1..127: mol_type = other RNA

SEQ ID NO: 37220 - RNA, 118 nt, synthetic construct; identical to SEQ ID NO: 30499
  source 1..118: mol_type = other RNA

SEQ ID NO: 37221 - RNA, 116 nt, synthetic construct; identical to SEQ ID NO: 30500
  source 1..116: mol_type = other RNA

SEQ ID NO: 37222 - RNA, 100 nt, synthetic construct; identical to SEQ ID NO: 30501
  source 1..100: mol_type = other RNA

SEQ ID NO: 37223 - RNA, 100 nt, synthetic construct; identical to SEQ ID NO: 30502
  source 1..100: mol_type = other RNA

SEQ ID NO: 37224 - RNA, 100 nt, synthetic construct; identical to SEQ ID NO: 30503
  source 1..100: mol_type = other RNA

SEQ ID NO: 37225 - RNA, 100 nt, synthetic construct; identical to SEQ ID NO: 30504
  source 1..100: mol_type = other RNA

SEQ ID NO: 37226 - RNA, 100 nt, synthetic construct; identical to SEQ ID NO: 30505
  source 1..100: mol_type = other RNA

SEQ ID NO: 37227 - RNA, 118 nt, synthetic construct; identical to SEQ ID NO: 30492
  source 1..118: mol_type = other RNA

SEQ ID NO: 37228 - RNA, 117 nt, synthetic construct; identical to SEQ ID NO: 30491
  source 1..117: mol_type = other RNA

SEQ ID NO: 37229 - RNA, 120 nt, synthetic construct; identical to SEQ ID NO: 30538
  source 1..120: mol_type = other RNA

SEQ ID NO: 37230 - RNA, 116 nt, synthetic construct; identical to SEQ ID NO: 30490
  source 1..116: mol_type = other RNA

SEQ ID NO: 37231 - RNA, 124 nt, synthetic construct; identical to SEQ ID NO: 30540
  source 1..124: mol_type = other RNA

SEQ ID NO: 37232 - RNA, 119 nt, synthetic construct; identical to SEQ ID NO: 30493
  source 1..119: mol_type = other RNA

SEQ ID NO: 37233 - RNA, 121 nt, synthetic construct; identical to SEQ ID NO: 30542
  source 1..121: mol_type = other RNA

SEQ ID NO: 37234 - RNA, 122 nt, synthetic construct; identical to SEQ ID NO: 30494
  source 1..122: mol_type = other RNA

SEQ ID NO: 37235 - RNA, 126 nt, synthetic construct; identical to SEQ ID NO: 30544
  source 1..126: mol_type = other RNA

SEQ ID NO: 37236 - RNA, 115 nt, synthetic construct; identical to SEQ ID NO: 30489
  source 1..115: mol_type = other RNA

SEQ ID NO: 37237 - RNA, 123 nt, synthetic construct; identical to SEQ ID NO: 30497
  source 1..123: mol_type = other RNA

SEQ ID NO: 37238 - RNA, 121 nt, synthetic construct; identical to SEQ ID NO: 30487
  source 1..121: mol_type = other RNA

SEQ ID NO: 37239 - RNA, 122 nt, synthetic construct; identical to SEQ ID NO: 30488
  source 1..122: mol_type = other RNA

SEQ ID NO: 37240 - RNA, 124 nt, synthetic construct; identical to SEQ ID NO: 30549
  source 1..124: mol_type = other RNA

SEQ ID NO: 37241 - RNA, 125 nt, synthetic construct; identical to SEQ ID NO: 30550
  source 1..125: mol_type = other RNA

SEQ ID NO: 37242 - RNA, 122 nt, synthetic construct; identical to SEQ ID NO: 30551
  source 1..122: mol_type = other RNA

SEQ ID NO: 37243 - RNA, 125 nt, synthetic construct; identical to SEQ ID NO: 30552
  source 1..125: mol_type = other RNA

SEQ ID NO: 37244 - RNA, 119 nt, synthetic construct; identical to SEQ ID NO: 30553
  source 1..119: mol_type = other RNA

SEQ ID NO: 37245 - RNA, 129 nt, synthetic construct; identical to SEQ ID NO: 30554
  source 1..129: mol_type = other RNA

SEQ ID NO: 37246 - RNA, 127 nt, synthetic construct; identical to SEQ ID NO: 30498
  source 1..127: mol_type = other RNA

SEQ ID NO: 37247 - RNA, 121 nt, synthetic construct; identical to SEQ ID NO: 30496
  source 1..121: mol_type = other RNA

SEQ ID NO: 37248 - RNA, 123 nt, synthetic construct; identical to SEQ ID NO: 30557
  source 1..123: mol_type = other RNA

SEQ ID NO: 37249 - RNA, 122 nt, synthetic construct; identical to SEQ ID NO: 30485
  source 1..122: mol_type = other RNA

SEQ ID NO: 37250 - RNA, 123 nt, synthetic construct; identical to SEQ ID NO: 30559
  source 1..123: mol_type = other RNA

SEQ ID NO: 37251 - RNA, 124 nt, synthetic construct; identical to SEQ ID NO: 30486
  source 1..124: mol_type = other RNA

SEQ ID NO: 37252 - RNA, 127 nt, synthetic construct; identical to SEQ ID NO: 30561
  source 1..127: mol_type = other RNA

SEQ ID NO: 37253 - RNA, 125 nt, synthetic construct; identical to SEQ ID NO: 30562
  source 1..125: mol_type = other RNA

SEQ ID NO: 37254 - RNA, 125 nt, synthetic construct; identical to SEQ ID NO: 30563
  source 1..125: mol_type = other RNA

SEQ ID NO: 37255 - RNA, 124 nt, synthetic construct; identical to SEQ ID NO: 30495
  source 1..124: mol_type = other RNA

SEQ ID NO: 37256 - RNA, 126 nt, synthetic construct; identical to SEQ ID NO: 30565
  source 1..126: mol_type = other RNA

SEQ ID NO: 37257 - RNA, 117 nt, synthetic construct; identical to SEQ ID NO: 30566
  source 1..117: mol_type = other RNA

SEQ ID NO: 37258 - RNA, 124 nt, synthetic construct; identical to SEQ ID NO: 30567
  source 1..124: mol_type = other RNA

SEQ ID NO: 37259 - RNA, 118 nt, synthetic construct; identical to SEQ ID NO: 30568
  source 1..118: mol_type = other RNA

SEQ ID NO: 37260 - RNA, 118 nt, synthetic construct; identical to SEQ ID NO: 30499
  source 1..118: mol_type = other RNA

SEQ ID NO: 37261 - RNA, 122 nt, synthetic construct; identical to SEQ ID NO: 30570
  source 1..122: mol_type = other RNA

SEQ ID NO: 37262 - RNA, 119 nt, synthetic construct; identical to SEQ ID NO: 30571
  source 1..119: mol_type = other RNA

SEQ ID NO: 37263 - RNA, 120 nt, synthetic construct; identical to SEQ ID NO: 30572
  source 1..120: mol_type = other RNA

SEQ ID NO: 37264 - RNA, 116 nt, synthetic construct; identical to SEQ ID NO: 30500
  source 1..116: mol_type = other RNA

SEQ ID NO: 37265 - RNA, 122 nt, synthetic construct; identical to SEQ ID NO: 30574
  source 1..122: mol_type = other RNA

SEQ ID NO: 37266 - RNA, 116 nt, synthetic construct; identical to SEQ ID NO: 30575
  source 1..116: mol_type = other RNA

SEQ ID NO: 37267 - RNA, 131 nt, synthetic construct; identical to SEQ ID NO: 30674
  source 1..131: mol_type = other RNA

SEQ ID NO: 37268 - RNA, 131 nt, synthetic construct; identical to SEQ ID NO: 30675
  source 1..131: mol_type = other RNA

SEQ ID NO: 37269 - RNA, 131 nt, synthetic construct; identical to SEQ ID NO: 30676
  source 1..131: mol_type = other RNA

SEQ ID NO: 37270 - RNA, 131 nt, synthetic construct; identical to SEQ ID NO: 30677
  source 1..131: mol_type = other RNA

SEQ ID NO: 37271 - RNA, 131 nt, synthetic construct; identical to SEQ ID NO: 30678
  source 1..131: mol_type = other RNA

SEQ ID NO: 37272 - RNA, 131 nt, synthetic construct; identical to SEQ ID NO: 30679
  source 1..131: mol_type = other RNA

SEQ ID NO: 37273 - RNA, 129 nt, synthetic construct; identical to SEQ ID NO: 30680
  source 1..129: mol_type = other RNA

SEQ ID NO: 37274 - RNA, 129 nt, synthetic construct; identical to SEQ ID NO: 30681
  source 1..129: mol_type = other RNA

SEQ ID NO: 37275 - RNA, 129 nt, synthetic construct; identical to SEQ ID NO: 30682
  source 1..129: mol_type = other RNA

SEQ ID NO: 37276 - RNA, 129 nt, synthetic construct; identical to SEQ ID NO: 30683
  source 1..129: mol_type = other RNA

SEQ ID NO: 37277 - RNA, 129 nt, synthetic construct; identical to SEQ ID NO: 30684
  source 1..129: mol_type = other RNA

SEQ ID NO: 37278 - RNA, 129 nt, synthetic construct; identical to SEQ ID NO: 30685
  source 1..129: mol_type = other RNA

SEQ ID NO: 37279 - RNA, 127 nt, synthetic construct; identical to SEQ ID NO: 30686
  source 1..127: mol_type = other RNA

SEQ ID NO: 37280 - RNA, 127 nt, synthetic construct; identical to SEQ ID NO: 30687
  source 1..127: mol_type = other RNA

SEQ ID NO: 37281 - RNA, 127 nt, synthetic construct; identical to SEQ ID NO: 30688
  source 1..127: mol_type = other RNA

SEQ ID NO: 37282 - RNA, 127 nt, synthetic construct; identical to SEQ ID NO: 30689
  source 1..127: mol_type = other RNA

SEQ ID NO: 37283 - RNA, 127 nt, synthetic construct; identical to SEQ ID NO: 30690
  source 1..127: mol_type = other RNA

SEQ ID NO: 37284 - RNA, 127 nt, synthetic construct; identical to SEQ ID NO: 30691
  source 1..127: mol_type = other RNA

SEQ ID NO: 37285 - RNA, 125 nt, synthetic construct; identical to SEQ ID NO: 30562
  source 1..125: mol_type = other RNA

SEQ ID NO: 37286 - RNA, 125 nt, synthetic construct; identical to SEQ ID NO: 30693
  source 1..125: mol_type = other RNA

SEQ ID NO: 37287 - RNA, 125 nt, synthetic construct; identical to SEQ ID NO: 30694
  source 1..125: mol_type = other RNA

SEQ ID NO: 37288 - RNA, 125 nt, synthetic construct; identical to SEQ ID NO: 30695
  source 1..125: mol_type = other RNA

SEQ ID NO: 37289 - RNA, 125 nt, synthetic construct; identical to SEQ ID NO: 30696
  source 1..125: mol_type = other RNA

SEQ ID NO: 37290 - RNA, 125 nt, synthetic construct; identical to SEQ ID NO: 30697
  source 1..125: mol_type = other RNA

SEQ ID NO: 37291 - RNA, 123 nt, synthetic construct; identical to SEQ ID NO: 30559
  source 1..123: mol_type = other RNA

SEQ ID NO: 37292 - RNA, 123 nt, synthetic construct; identical to SEQ ID NO: 30699
  source 1..123: mol_type = other RNA

SEQ ID NO: 37293 - RNA, 123 nt, synthetic construct; identical to SEQ ID NO: 30700
  source 1..123: mol_type = other RNA

SEQ ID NO: 37294 - RNA, 123 nt, synthetic construct; identical to SEQ ID NO: 30701
  source 1..123: mol_type = other RNA

SEQ ID NO: 37295 - RNA, 123 nt, synthetic construct; identical to SEQ ID NO: 30702
  source 1..123: mol_type = other RNA

SEQ ID NO: 37296 - RNA, 123 nt, synthetic construct; identical to SEQ ID NO: 30703
  source 1..123: mol_type = other RNA

SEQ ID NO: 37297 - RNA, 130 nt, synthetic construct; identical to SEQ ID NO: 30704
  source 1..130: mol_type = other RNA

SEQ ID NO: 37298 - RNA, 130 nt, synthetic construct; identical to SEQ ID NO: 30705
  source 1..130: mol_type = other RNA

SEQ ID NO: 37299 - RNA, 130 nt, synthetic construct; identical to SEQ ID NO: 30706
  source 1..130: mol_type = other RNA

SEQ ID NO: 37300 - RNA, 130 nt, synthetic construct; identical to SEQ ID NO: 30707
  source 1..130: mol_type = other RNA

SEQ ID NO: 37301 - RNA, 130 nt, synthetic construct; identical to SEQ ID NO: 30708
  source 1..130: mol_type = other RNA

SEQ ID NO: 37302 - RNA, 130 nt, synthetic construct; identical to SEQ ID NO: 30709
  source 1..130: mol_type = other RNA

SEQ ID NO: 37303 - RNA, 128 nt, synthetic construct; identical to SEQ ID NO: 30710
  source 1..128: mol_type = other RNA

SEQ ID NO: 37304 - RNA, 128 nt, synthetic construct; identical to SEQ ID NO: 30711
  source 1..128: mol_type = other RNA

SEQ ID NO: 37305 - RNA, 128 nt, synthetic construct; identical to SEQ ID NO: 30712
  source 1..128: mol_type = other RNA

SEQ ID NO: 37306 - RNA, 128 nt, synthetic construct; identical to SEQ ID NO: 30713
  source 1..128: mol_type = other RNA

SEQ ID NO: 37307 - RNA, 128 nt, synthetic construct; identical to SEQ ID NO: 30714
  source 1..128: mol_type = other RNA

SEQ ID NO: 37308 - RNA, 128 nt, synthetic construct; identical to SEQ ID NO: 30715
  source 1..128: mol_type = other RNA

SEQ ID NO: 37309 - RNA, 126 nt, synthetic construct; identical to SEQ ID NO: 30716
  source 1..126: mol_type = other RNA

SEQ ID NO: 37310 - RNA, 126 nt, synthetic construct; identical to SEQ ID NO: 30717
  source 1..126: mol_type = other RNA

SEQ ID NO: 37311 - RNA, 126 nt, synthetic construct; identical to SEQ ID NO: 30718
  source 1..126: mol_type = other RNA

SEQ ID NO: 37312 - RNA, 126 nt, synthetic construct; identical to SEQ ID NO: 30719
  source 1..126: mol_type = other RNA

SEQ ID NO: 37313 - RNA, 126 nt, synthetic construct; identical to SEQ ID NO: 30720
  source 1..126: mol_type = other RNA

SEQ ID NO: 37314 - RNA, 126 nt, synthetic construct; identical to SEQ ID NO: 30721
  source 1..126: mol_type = other RNA

SEQ ID NO: 37315 - RNA, 124 nt, synthetic construct; identical to SEQ ID NO: 30486
  source 1..124: mol_type = other RNA

SEQ ID NO: 37316 - RNA, 124 nt, synthetic construct; identical to SEQ ID NO: 30723
  source 1..124: mol_type = other RNA

SEQ ID NO: 37317 - RNA, 124 nt, synthetic construct; identical to SEQ ID NO: 30724
  source 1..124: mol_type = other RNA

SEQ ID NO: 37318 - RNA, 124 nt, synthetic construct; identical to SEQ ID NO: 30725
  source 1..124: mol_type = other RNA

SEQ ID NO: 37319 - RNA, 124 nt, synthetic construct; identical to SEQ ID NO: 30726
  source 1..124: mol_type = other RNA

SEQ ID NO: 37320 - RNA, 124 nt, synthetic construct; identical to SEQ ID NO: 30727
  source 1..124: mol_type = other RNA

SEQ ID NO: 37321 - RNA, 122 nt, synthetic construct; identical to SEQ ID NO: 30485
  source 1..122: mol_type = other RNA

SEQ ID NO: 37322 - RNA, 122 nt, synthetic construct; identical to SEQ ID NO: 30729
  source 1..122: mol_type = other RNA

SEQ ID NO: 37323 - RNA, 122 nt, synthetic construct; identical to SEQ ID NO: 30730
  source 1..122: mol_type = other RNA

SEQ ID NO: 37324 - RNA, 122 nt, synthetic construct; identical to SEQ ID NO: 30731
  source 1..122: mol_type = other RNA

SEQ ID NO: 37325 - RNA, 122 nt, synthetic construct; identical to SEQ ID NO: 30732
  source 1..122: mol_type = other RNA

SEQ ID NO: 37326 - RNA, 122 nt, synthetic construct; identical to SEQ ID NO: 30733
  source 1..122: mol_type = other RNA

SEQ ID NO: 37327 - RNA, 129 nt, synthetic construct; identical to SEQ ID NO: 30734
  source 1..129: mol_type = other RNA

SEQ ID NO: 37328 - RNA, 129 nt, synthetic construct; identical to SEQ ID NO: 30735
  source 1..129: mol_type = other RNA

SEQ ID NO: 37329 - RNA, 129 nt, synthetic construct; identical to SEQ ID NO: 30736
  source 1..129: mol_type = other RNA

SEQ ID NO: 37330 - RNA, 129 nt, synthetic construct; identical to SEQ ID NO: 30737
  source 1..129: mol_type = other RNA

SEQ ID NO: 37331 - RNA, 129 nt, synthetic construct; identical to SEQ ID NO: 30738
  source 1..129: mol_type = other RNA

SEQ ID NO: 37332 - RNA, 129 nt, synthetic construct; identical to SEQ ID NO: 30739
  source 1..129: mol_type = other RNA

SEQ ID NO: 37333 - RNA, 127 nt, synthetic construct; identical to SEQ ID NO: 30561
  source 1..127: mol_type = other RNA

SEQ ID NO: 37334 - RNA, 127 nt, synthetic construct; identical to SEQ ID NO: 30741
  source 1..127: mol_type = other RNA

SEQ ID NO: 37335 - RNA, 127 nt, synthetic construct; identical to SEQ ID NO: 30742
  source 1..127: mol_type = other RNA

SEQ ID NO: 37336 - RNA, 127 nt, synthetic construct; identical to SEQ ID NO: 30743
  source 1..127: mol_type = other RNA

SEQ ID NO: 37337 - RNA, 127 nt, synthetic construct; identical to SEQ ID NO: 30744
  source 1..127: mol_type = other RNA

SEQ ID NO: 37338 - RNA, 127 nt, synthetic construct; identical to SEQ ID NO: 30745
  source 1..127: mol_type = other RNA

SEQ ID NO: 37339 - RNA, 125 nt, synthetic construct; identical to SEQ ID NO: 30746
  source 1..125: mol_type = other RNA

SEQ ID NO: 37340 - RNA, 125 nt, synthetic construct; identical to SEQ ID NO: 30747
  source 1..125: mol_type = other RNA

SEQ ID NO: 37341 - RNA, 125 nt, synthetic construct; identical to SEQ ID NO: 30748
  source 1..125: mol_type = other RNA

SEQ ID NO: 37342 - RNA, 125 nt, synthetic construct; identical to SEQ ID NO: 30749
  source 1..125: mol_type = other RNA

SEQ ID NO: 37343 - RNA, 125 nt, synthetic construct; identical to SEQ ID NO: 30750
  source 1..125: mol_type = other RNA

SEQ ID NO: 37344 - RNA, 125 nt, synthetic construct; identical to SEQ ID NO: 30751
  source 1..125: mol_type = other RNA

SEQ ID NO: 37345 - RNA, 123 nt, synthetic construct; identical to SEQ ID NO: 30557
  source 1..123: mol_type = other RNA

SEQ ID NO: 37346 - RNA, 123 nt, synthetic construct; identical to SEQ ID NO: 30753
  source 1..123: mol_type = other RNA

SEQ ID NO: 37347 - RNA, 123 nt, synthetic construct; identical to SEQ ID NO: 30754
  source 1..123: mol_type = other RNA

SEQ ID NO: 37348 - RNA, 123 nt, synthetic construct; identical to SEQ ID NO: 30755
  source 1..123: mol_type = other RNA

SEQ ID NO: 37349 - RNA, 123 nt, synthetic construct; identical to SEQ ID NO: 30756
  source 1..123: mol_type = other RNA

SEQ ID NO: 37350 - RNA, 123 nt, synthetic construct; identical to SEQ ID NO: 30757
  source 1..123: mol_type = other RNA

SEQ ID NO: 37351 - RNA, 121 nt, synthetic construct; identical to SEQ ID NO: 30496
  source 1..121: mol_type = other RNA

SEQ ID NO: 37352 - RNA, 121 nt, synthetic construct; identical to SEQ ID NO: 30759
  source 1..121: mol_type = other RNA

SEQ ID NO: 37353 - RNA, 121 nt, synthetic construct; identical to SEQ ID NO: 30760
  source 1..121: mol_type = other RNA

SEQ ID NO: 37354 - RNA, 121 nt, synthetic construct; identical to SEQ ID NO: 30761
  source 1..121: mol_type = other RNA

SEQ ID NO: 37355 - RNA, 121 nt, synthetic construct; identical to SEQ ID NO: 30762
  source 1..121: mol_type = other RNA

SEQ ID NO: 37356 - RNA, 121 nt, synthetic construct; identical to SEQ ID NO: 30763
  source 1..121: mol_type = other RNA

SEQ ID NO: 37357 - RNA, 130 nt, synthetic construct; identical to SEQ ID NO: 30764
  source 1..130: mol_type = other RNA

SEQ ID NO: 37358 - RNA, 130 nt, synthetic construct; identical to SEQ ID NO: 30765
  source 1..130: mol_type = other RNA

SEQ ID NO: 37359 - RNA, 130 nt, synthetic construct; identical to SEQ ID NO: 30766
  source 1..130: mol_type = other RNA

SEQ ID NO: 37360 - RNA, 130 nt, synthetic construct; identical to SEQ ID NO: 30767
  source 1..130: mol_type = other RNA

SEQ ID NO: 37361 - RNA, 130 nt, synthetic construct; identical to SEQ ID NO: 30768
  source 1..130: mol_type = other RNA

SEQ ID NO: 37362 - RNA, 130 nt, synthetic construct; identical to SEQ ID NO: 30769
  source 1..130: mol_type = other RNA

SEQ ID NO: 37363 - RNA, 128 nt, synthetic construct; identical to SEQ ID NO: 30770
  source 1..128: mol_type = other RNA

SEQ ID NO: 37364 - RNA, 128 nt, synthetic construct; identical to SEQ ID NO: 30771
  source 1..128: mol_type = other RNA

SEQ ID NO: 37365 - RNA, 128 nt, synthetic construct; identical to SEQ ID NO: 30772
  source 1..128: mol_type = other RNA

SEQ ID NO: 37366 - RNA, 128 nt, synthetic construct; identical to SEQ ID NO: 30773
  source 1..128: mol_type = other RNA

SEQ ID NO: 37367 - RNA, 128 nt, synthetic construct; identical to SEQ ID NO: 30774
  source 1..128: mol_type = other RNA

SEQ ID NO: 37368 - RNA, 128 nt, synthetic construct; identical to SEQ ID NO: 30775
  source 1..128: mol_type = other RNA

SEQ ID NO: 37369 - RNA, 126 nt, synthetic construct; identical to SEQ ID NO: 30776
  source 1..126: mol_type = other RNA

SEQ ID NO: 37370 - RNA, 126 nt, synthetic construct; identical to SEQ ID NO: 30777
  source 1..126: mol_type = other RNA

SEQ ID NO: 37371 - RNA, 126 nt, synthetic construct; identical to SEQ ID NO: 30778
  source 1..126: mol_type = other RNA

SEQ ID NO: 37372 - RNA, 126 nt, synthetic construct; identical to SEQ ID NO: 30779
  source 1..126: mol_type = other RNA

SEQ ID NO: 37373 - RNA, 126 nt, synthetic construct; identical to SEQ ID NO: 30780
  source 1..126: mol_type = other RNA

SEQ ID NO: 37374 - RNA, 126 nt, synthetic construct; identical to SEQ ID NO: 30781
  source 1..126: mol_type = other RNA

SEQ ID NO: 37375 - RNA, 124 nt, synthetic construct; identical to SEQ ID NO: 30549
  source 1..124: mol_type = other RNA

SEQ ID NO: 37376 - RNA, 124 nt, synthetic construct; identical to SEQ ID NO: 30783
  source 1..124: mol_type = other RNA

SEQ ID NO: 37377 - RNA, 124 nt, synthetic construct; identical to SEQ ID NO: 30784
  source 1..124: mol_type = other RNA

SEQ ID NO: 37378 - RNA, 124 nt, synthetic construct; identical to SEQ ID NO: 30785
  source 1..124: mol_type = other RNA

SEQ ID NO: 37379 - RNA, 124 nt, synthetic construct; identical to SEQ ID NO: 30786
  source 1..124: mol_type = other RNA

SEQ ID NO: 37380 - RNA, 124 nt, synthetic construct; identical to SEQ ID NO: 30787
  source 1..124: mol_type = other RNA

SEQ ID NO: 37381 - RNA, 122 nt, synthetic construct; identical to SEQ ID NO: 30488
  source 1..122: mol_type = other RNA

SEQ ID NO: 37382 - RNA, 122 nt, synthetic construct; identical to SEQ ID NO: 30789
  source 1..122: mol_type = other RNA

SEQ ID NO: 37383 - RNA, 122 nt, synthetic construct; identical to SEQ ID NO: 30790
  source 1..122: mol_type = other RNA

SEQ ID NO: 37384 - RNA, 122 nt, synthetic construct; identical to SEQ ID NO: 30791
  source 1..122: mol_type = other RNA

SEQ ID NO: 37385 - RNA, 122 nt, synthetic construct; identical to SEQ ID NO: 30792
  source 1..122: mol_type = other RNA

SEQ ID NO: 37386 - RNA, 122 nt, synthetic construct; identical to SEQ ID NO: 30793
  source 1..122: mol_type = other RNA

SEQ ID NO: 37387 - RNA, 129 nt, synthetic construct; identical to SEQ ID NO: 30554
  source 1..129: mol_type = other RNA

SEQ ID NO: 37388 - RNA, 129 nt, synthetic construct; identical to SEQ ID NO: 30795
  source 1..129: mol_type = other RNA

SEQ ID NO: 37389 - RNA, 129 nt, synthetic construct; identical to SEQ ID NO: 30796
  source 1..129: mol_type = other RNA

SEQ ID NO: 37390 - RNA, 129 nt, synthetic construct; identical to SEQ ID NO: 30797
  source 1..129: mol_type = other RNA

SEQ ID NO: 37391 - RNA, 129 nt, synthetic construct; identical to SEQ ID NO: 30798
  source 1..129: mol_type = other RNA

SEQ ID NO: 37392 - RNA, 129 nt, synthetic construct; identical to SEQ ID NO: 30799
  source 1..129: mol_type = other RNA

SEQ ID NO: 37393 - RNA, 127 nt, synthetic construct; identical to SEQ ID NO: 30498
  source 1..127: mol_type = other RNA

SEQ ID NO: 37394 - RNA, 127 nt, synthetic construct; identical to SEQ ID NO: 30801
  source 1..127: mol_type = other RNA

SEQ ID NO: 37395 - RNA, 127 nt, synthetic construct; identical to SEQ ID NO: 30802
  source 1..127: mol_type = other RNA

SEQ ID NO: 37396 - RNA, 127 nt, synthetic construct; identical to SEQ ID NO: 30803
  source 1..127: mol_type = other RNA

SEQ ID NO: 37397 - RNA, 127 nt, synthetic construct; identical to SEQ ID NO: 30804
  source 1..127: mol_type = other RNA

SEQ ID NO: 37398 - RNA, 127 nt, synthetic construct; identical to SEQ ID NO: 30805
  source 1..127: mol_type = other RNA

SEQ ID NO: 37399 - RNA, 125 nt, synthetic construct; identical to SEQ ID NO: 30552
  source 1..125: mol_type = other RNA

SEQ ID NO: 37400 - RNA, 125 nt, synthetic construct; identical to SEQ ID NO: 30807
  source 1..125: mol_type = other RNA

SEQ ID NO: 37401 - RNA, 125 nt, synthetic construct; identical to SEQ ID NO: 30808
  source 1..125: mol_type = other RNA

SEQ ID NO: 37402 - RNA, 125 nt, synthetic construct; identical to SEQ ID NO: 30809
  source 1..125: mol_type = other RNA

SEQ ID NO: 37403 - RNA, 125 nt, synthetic construct; identical to SEQ ID NO: 30810
  source 1..125: mol_type = other RNA

SEQ ID NO: 37404 - RNA, 125 nt, synthetic construct; identical to SEQ ID NO: 30811
  source 1..125: mol_type = other RNA

SEQ ID NO: 37405 - RNA, 123 nt, synthetic construct; identical to SEQ ID NO: 30497
  source 1..123: mol_type = other RNA

SEQ ID NO: 37406 - RNA, 123 nt, synthetic construct; identical to SEQ ID NO: 30813
  source 1..123: mol_type = other RNA

SEQ ID NO: 37407 - RNA, 123 nt, synthetic construct; identical to SEQ ID NO: 30814
  source 1..123: mol_type = other RNA

SEQ ID NO: 37408 - RNA, 123 nt, synthetic construct; identical to SEQ ID NO: 30815
  source 1..123: mol_type = other RNA

SEQ ID NO: 37409 - RNA, 123 nt, synthetic construct; identical to SEQ ID NO: 30816
  source 1..123: mol_type = other RNA

SEQ ID NO: 37410 - RNA, 123 nt, synthetic construct; identical to SEQ ID NO: 30817
  source 1..123: mol_type = other RNA

SEQ ID NO: 37411 - RNA, 121 nt, synthetic construct; identical to SEQ ID NO: 30487
  source 1..121: mol_type = other RNA

SEQ ID NO: 37412 - RNA, 121 nt, synthetic construct; identical to SEQ ID NO: 30819
  source 1..121: mol_type = other RNA

SEQ ID NO: 37413 - RNA, 121 nt, synthetic construct; identical to SEQ ID NO: 30820
  source 1..121: mol_type = other RNA

SEQ ID NO: 37414 - RNA, 121 nt, synthetic construct; identical to SEQ ID NO: 30821
  source 1..121: mol_type = other RNA

SEQ ID NO: 37415 - RNA, 121 nt, synthetic construct; identical to SEQ ID NO: 30822
  source 1..121: mol_type = other RNA

SEQ ID NO: 37416 - RNA, 121 nt, synthetic construct; identical to SEQ ID NO: 30823
  source 1..121: mol_type = other RNA

SEQ ID NO: 37417 - RNA, 128 nt, synthetic construct; identical to SEQ ID NO: 30824
  source 1..128: mol_type = other RNA

SEQ ID NO: 37418 - RNA, 128 nt, synthetic construct; identical to SEQ ID NO: 30825
  source 1..128: mol_type = other RNA

SEQ ID NO: 37419 - RNA, 128 nt, synthetic construct; identical to SEQ ID NO: 30826
  source 1..128: mol_type = other RNA

SEQ ID NO: 37420 - RNA, 128 nt, synthetic construct; identical to SEQ ID NO: 30827
  source 1..128: mol_type = other RNA

SEQ ID NO: 37421 - RNA, 128 nt, synthetic construct; identical to SEQ ID NO: 30828
  source 1..128: mol_type = other RNA

SEQ ID NO: 37422 - RNA, 128 nt, synthetic construct; identical to SEQ ID NO: 30829
  source 1..128: mol_type = other RNA

SEQ ID NO: 37423 - RNA, 126 nt, synthetic construct; identical to SEQ ID NO: 30830
  source 1..126: mol_type = other RNA

SEQ ID NO: 37424 - RNA, 126 nt, synthetic construct; identical to SEQ ID NO: 30831
  source 1..126: mol_type = other RNA

SEQ ID NO: 37425 - RNA, 126 nt, synthetic construct; identical to SEQ ID NO: 30832
  source 1..126: mol_type = other RNA

SEQ ID NO: 37426 - RNA, 126 nt, synthetic construct; identical to SEQ ID NO: 30833
  source 1..126: mol_type = other RNA

SEQ ID NO: 37427 - RNA, 126 nt, synthetic construct; identical to SEQ ID NO: 30834
  source 1..126: mol_type = other RNA

SEQ ID NO: 37428 - RNA, 126 nt, synthetic construct; identical to SEQ ID NO: 30835
  source 1..126: mol_type = other RNA

SEQ ID NO: 37429 - RNA, 124 nt, synthetic construct; identical to SEQ ID NO: 30836
  source 1..124: mol_type = other RNA

SEQ ID NO: 37430 - RNA, 124 nt, synthetic construct; identical to SEQ ID NO: 30837
  source 1..124: mol_type = other RNA

SEQ ID NO: 37431 - RNA, 124 nt, synthetic construct; identical to SEQ ID NO: 30838
  source 1..124: mol_type = other RNA

SEQ ID NO: 37432 - RNA, 124 nt, synthetic construct; identical to SEQ ID NO: 30839
  source 1..124: mol_type = other RNA

SEQ ID NO: 37433 - RNA, 124 nt, synthetic construct; identical to SEQ ID NO: 30840
  source 1..124: mol_type = other RNA

SEQ ID NO: 37434 - RNA, 124 nt, synthetic construct; identical to SEQ ID NO: 30841
  source 1..124: mol_type = other RNA

SEQ ID NO: 37435 - RNA, 122 nt, synthetic construct; identical to SEQ ID NO: 30551
  source 1..122: mol_type = other RNA

SEQ ID NO: 37436 - RNA, 122 nt, synthetic construct; identical to SEQ ID NO: 30843
  source 1..122: mol_type = other RNA

SEQ ID NO: 37437 - RNA, 122 nt, synthetic construct; identical to SEQ ID NO: 30844
  source 1..122: mol_type = other RNA

SEQ ID NO: 37438 - RNA, 122 nt, synthetic construct; identical to SEQ ID NO: 30845
  source 1..122: mol_type = other RNA

SEQ ID NO: 37439 - RNA, 122 nt, synthetic construct; identical to SEQ ID NO: 30846
  source 1..122: mol_type = other RNA

SEQ ID NO: 37440 - RNA, 122 nt, synthetic construct; identical to SEQ ID NO: 30847
  source 1..122: mol_type = other RNA

SEQ ID NO: 37441 - RNA, 120 nt, synthetic construct; identical to SEQ ID NO: 30848
  source 1..120: mol_type = other RNA

SEQ ID NO: 37442 - RNA, 120 nt, synthetic construct; identical to SEQ ID NO: 30849
  source 1..120: mol_type = other RNA

SEQ ID NO: 37443 - RNA, 120 nt, synthetic construct; identical to SEQ ID NO: 30850
  source 1..120: mol_type = other RNA

SEQ ID NO: 37444 - RNA, 120 nt, synthetic construct; identical to SEQ ID NO: 30851
  source 1..120: mol_type = other RNA

SEQ ID NO: 37445 - RNA, 120 nt, synthetic construct; identical to SEQ ID NO: 30852
  source 1..120: mol_type = other RNA

SEQ ID NO: 37446 - RNA, 120 nt, synthetic construct; identical to SEQ ID NO: 30853
  source 1..120: mol_type = other RNA

SEQ ID NO: 37447 - RNA, 126 nt, synthetic construct; identical to SEQ ID NO: 30544
  source 1..126: mol_type = other RNA

SEQ ID NO: 37448 - RNA, 126 nt, synthetic construct; identical to SEQ ID NO: 30855
  source 1..126: mol_type = other RNA

SEQ ID NO: 37449 - RNA, 126 nt, synthetic construct; identical to SEQ ID NO: 30856
  source 1..126: mol_type = other RNA

SEQ ID NO: 37450 - RNA, 126 nt, synthetic construct; identical to SEQ ID NO: 30857
  source 1..126: mol_type = other RNA

SEQ ID NO: 37451 - RNA, 126 nt, synthetic construct; identical to SEQ ID NO: 30858
  source 1..126: mol_type = other RNA

SEQ ID NO: 37452 - RNA, 126 nt, synthetic construct; identical to SEQ ID NO: 30859
  source 1..126: mol_type = other RNA

SEQ ID NO: 37453 - RNA, 124 nt, synthetic construct; identical to SEQ ID NO: 30540
  source 1..124: mol_type = other RNA

SEQ ID NO: 37454 - RNA, 124 nt, synthetic construct; identical to SEQ ID NO: 30861
  source 1..124: mol_type = other RNA

SEQ ID NO: 37455 - RNA, 124 nt, synthetic construct; identical to SEQ ID NO: 30862
  source 1..124: mol_type = other RNA

SEQ ID NO: 37456 - RNA, 124 nt, synthetic construct; identical to SEQ ID NO: 30863
  source 1..124: mol_type = other RNA

SEQ ID NO: 37457 - RNA, 124 nt, synthetic construct; identical to SEQ ID NO: 30864
  source 1..124: mol_type = other RNA

SEQ ID NO: 37458 - RNA, 124 nt, synthetic construct; identical to SEQ ID NO: 30865
  source 1..124: mol_type = other RNA

SEQ ID NO: 37459 - RNA, 122 nt, synthetic construct; identical to SEQ ID NO: 30866
  source 1..122: mol_type = other RNA

SEQ ID NO: 37460 - RNA, 122 nt, synthetic construct; identical to SEQ ID NO: 30867
  source 1..122: mol_type = other RNA

SEQ ID NO: 37461 - RNA, 122 nt, synthetic construct; identical to SEQ ID NO: 30868
  source 1..122: mol_type = other RNA

SEQ ID NO: 37462 - RNA, 122 nt, synthetic construct; identical to SEQ ID NO: 30869
  source 1..122: mol_type = other RNA

SEQ ID NO: 37463 - RNA, 122 nt, synthetic construct; identical to SEQ ID NO: 30870
  source 1..122: mol_type = other RNA

SEQ ID NO: 37464 - RNA, 122 nt, synthetic construct; identical to SEQ ID NO: 30871
  source 1..122: mol_type = other RNA

SEQ ID NO: 37465 - RNA, 120 nt, synthetic construct; identical to SEQ ID NO: 30872
  source 1..120: mol_type = other RNA

SEQ ID NO: 37466 - RNA, 120 nt, synthetic construct; identical to SEQ ID NO: 30873
  source 1..120: mol_type = other RNA

SEQ ID NO: 37467 - RNA, 120 nt, synthetic construct; identical to SEQ ID NO: 30874
  source 1..120: mol_type = other RNA

SEQ ID NO: 37468 - RNA, 120 nt, synthetic construct; identical to SEQ ID NO: 30875
  source 1..120: mol_type = other RNA

SEQ ID NO: 37469 - RNA, 120 nt, synthetic construct; identical to SEQ ID NO: 30876
  source 1..120: mol_type = other RNA

SEQ ID NO: 37470 - RNA, 120 nt, synthetic construct; identical to SEQ ID NO: 30877
  source 1..120: mol_type = other RNA

SEQ ID NO: 37471 - RNA, 118 nt, synthetic construct; identical to SEQ ID NO: 30492
  source 1..118: mol_type = other RNA

SEQ ID NO: 37472 - RNA, 118 nt, synthetic construct; identical to SEQ ID NO: 30879
  source 1..118: mol_type = other RNA

SEQ ID NO: 37473 - RNA, 118 nt, synthetic construct; identical to SEQ ID NO: 30880
  source 1..118: mol_type = other RNA

SEQ ID NO: 37474 - RNA, 118 nt, synthetic construct; identical to SEQ ID NO: 30881
  source 1..118: mol_type = other RNA

SEQ ID NO: 37475 - RNA, 118 nt, synthetic construct; identical to SEQ ID NO: 30882
  source 1..118: mol_type = other RNA

SEQ ID NO: 37476 - RNA, 118 nt, synthetic construct; identical to SEQ ID NO: 30883
  source 1..118: mol_type = other RNA

SEQ ID NO: 37477 - RNA, 125 nt, synthetic construct; identical to SEQ ID NO: 30884
  source 1..125: mol_type = other RNA

SEQ ID NO: 37478 - RNA, 125 nt, synthetic construct; identical to SEQ ID NO: 30885
  source 1..125: mol_type = other RNA

SEQ ID NO: 37479 - RNA, 125 nt, synthetic construct; identical to SEQ ID NO: 30886
  source 1..125: mol_type = other RNA

SEQ ID NO: 37480 - RNA, 125 nt, synthetic construct; identical to SEQ ID NO: 30887
  source 1..125: mol_type = other RNA

SEQ ID NO: 37481 - RNA, 125 nt, synthetic construct; identical to SEQ ID NO: 30888
  source 1..125: mol_type = other RNA

SEQ ID NO: 37482 - RNA, 125 nt, synthetic construct; identical to SEQ ID NO: 30889
  source 1..125: mol_type = other RNA

SEQ ID NO: 37483 - RNA, 123 nt, synthetic construct; identical to SEQ ID NO: 30890
  source 1..123: mol_type = other RNA

SEQ ID NO: 37484 - RNA, 123 nt, synthetic construct; identical to SEQ ID NO: 30891
  source 1..123: mol_type = other RNA

SEQ ID NO: 37485 - RNA, 123 nt, synthetic construct; identical to SEQ ID NO: 30892
  source 1..123: mol_type = other RNA

SEQ ID NO: 37486 - RNA, 123 nt, synthetic construct; identical to SEQ ID NO: 30893
  source 1..123: mol_type = other RNA

SEQ ID NO: 37487 - RNA, 123 nt, synthetic construct; identical to SEQ ID NO: 30894
  source 1..123: mol_type = other RNA

SEQ ID NO: 37488 - RNA, 123 nt, synthetic construct; identical to SEQ ID NO: 30895
  source 1..123: mol_type = other RNA

SEQ ID NO: 37489 - RNA, 121 nt, synthetic construct; identical to SEQ ID NO: 30542
  source 1..121: mol_type = other RNA

SEQ ID NO: 37490 - RNA, 121 nt, synthetic construct; identical to SEQ ID NO: 30897
  source 1..121: mol_type = other RNA

SEQ ID NO: 37491 - RNA, 121 nt, synthetic construct; identical to SEQ ID NO: 30898
  source 1..121: mol_type = other RNA

SEQ ID NO: 37492 - RNA, 121 nt, synthetic construct; identical to SEQ ID NO: 30899
  source 1..121: mol_type = other RNA

SEQ ID NO: 37493 - RNA, 121 nt, synthetic construct; identical to SEQ ID NO: 30900
  source 1..121: mol_type = other RNA

SEQ ID NO: 37494 - RNA, 121 nt, synthetic construct; identical to SEQ ID NO: 30901
  source 1..121: mol_type = other RNA

SEQ ID NO: 37495 - RNA, 119 nt, synthetic construct; identical to SEQ ID NO: 30902
  source 1..119: mol_type = other RNA

SEQ ID NO: 37496 - RNA, 119 nt, synthetic construct; identical to SEQ ID NO: 30903
  source 1..119: mol_type = other RNA

SEQ ID NO: 37497 - RNA, 119 nt, synthetic construct; identical to SEQ ID NO: 30904
  source 1..119: mol_type = other RNA

SEQ ID NO: 37498 - RNA, 119 nt, synthetic construct; identical to SEQ ID NO: 30905
  source 1..119: mol_type = other RNA

SEQ ID NO: 37499 - RNA, 119 nt, synthetic construct; identical to SEQ ID NO: 30906
  source 1..119: mol_type = other RNA

SEQ ID NO: 37500 - RNA, 119 nt, synthetic construct; identical to SEQ ID NO: 30907
  source 1..119: mol_type = other RNA

SEQ ID NO: 37501 - RNA, 117 nt, synthetic construct; identical to SEQ ID NO: 30908
  source 1..117: mol_type = other RNA

SEQ ID NO: 37502 - RNA, 117 nt, synthetic construct; identical to SEQ ID NO: 30909
  source 1..117: mol_type = other RNA

SEQ ID NO: 37503 - RNA, 117 nt, synthetic construct; identical to SEQ ID NO: 30910
  source 1..117: mol_type = other RNA

SEQ ID NO: 37504 - RNA, 117 nt, synthetic construct; identical to SEQ ID NO: 30911
  source 1..117: mol_type = other RNA

SEQ ID NO: 37505 - RNA, 117 nt, synthetic construct; identical to SEQ ID NO: 30912
  source 1..117: mol_type = other RNA

SEQ ID NO: 37506 - RNA, 117 nt, synthetic construct; identical to SEQ ID NO: 30913
  source 1..117: mol_type = other RNA

SEQ ID NO: 37507 - RNA, 124 nt, synthetic construct; identical to SEQ ID NO: 30914
  source 1..124: mol_type = other RNA

SEQ ID NO: 37508 - RNA, 124 nt, synthetic construct; identical to SEQ ID NO: 30915
  source 1..124: mol_type = other RNA

SEQ ID NO: 37509 - RNA, 124 nt, synthetic construct; identical to SEQ ID NO: 30916
  source 1..124: mol_type = other RNA

SEQ ID NO: 37510 - RNA, 124 nt, synthetic construct; identical to SEQ ID NO: 30917
  source 1..124: mol_type = other RNA

SEQ ID NO: 37511 - RNA, 124 nt, synthetic construct; identical to SEQ ID NO: 30918
  source 1..124: mol_type = other RNA

SEQ ID NO: 37512 - RNA, 124 nt, synthetic construct; identical to SEQ ID NO: 30919
  source 1..124: mol_type = other RNA

SEQ ID NO: 37513 - RNA, 122 nt, synthetic construct; identical to SEQ ID NO: 30494
  source 1..122: mol_type = other RNA

SEQ ID NO: 37514 - RNA, 122 nt, synthetic construct; identical to SEQ ID NO: 30921
  source 1..122: mol_type = other RNA

SEQ ID NO: 37515 - RNA, 122 nt, synthetic construct; identical to SEQ ID NO: 30922
  source 1..122: mol_type = other RNA

SEQ ID NO: 37516 - RNA, 122 nt, synthetic construct; identical to SEQ ID NO: 30923
  source 1..122: mol_type = other RNA

SEQ ID NO: 37517 - RNA, 122 nt, synthetic construct; identical to SEQ ID NO: 30924
  source 1..122: mol_type = other RNA

SEQ ID NO: 37518 - RNA, 122 nt, synthetic construct; identical to SEQ ID NO: 30925
  source 1..122: mol_type = other RNA

SEQ ID NO: 37519 - RNA, 120 nt, synthetic construct; identical to SEQ ID NO: 30926
  source 1..120: mol_type = other RNA

SEQ ID NO: 37520 - RNA, 120 nt, synthetic construct; identical to SEQ ID NO: 30927
  source 1..120: mol_type = other RNA

SEQ ID NO: 37521 - RNA, 120 nt, synthetic construct; identical to SEQ ID NO: 30928
  source 1..120: mol_type = other RNA

SEQ ID NO: 37522 - RNA, 120 nt, synthetic construct; identical to SEQ ID NO: 30929
  source 1..120: mol_type = other RNA

SEQ ID NO: 37523 - RNA, 120 nt, synthetic construct; identical to SEQ ID NO: 30930
  source 1..120: mol_type = other RNA

SEQ ID NO: 37524 - RNA, 120 nt, synthetic construct; identical to SEQ ID NO: 30931
  source 1..120: mol_type = other RNA

SEQ ID NO: 37525 - RNA, 118 nt, synthetic construct; identical to SEQ ID NO: 30932
  source 1..118: mol_type = other RNA

SEQ ID NO: 37526 - RNA, 118 nt, synthetic construct; identical to SEQ ID NO: 30933
  source 1..118: mol_type = other RNA

SEQ ID NO: 37527 - RNA, 118 nt, synthetic construct; identical to SEQ ID NO: 30934
  source 1..118: mol_type = other RNA

SEQ ID NO: 37528 - RNA, 118 nt, synthetic construct; identical to SEQ ID NO: 30935
  source 1..118: mol_type = other RNA

SEQ ID NO: 37529 - RNA, 118 nt, synthetic construct; identical to SEQ ID NO: 30936
  source 1..118: mol_type = other RNA

SEQ ID NO: 37530 - RNA, 118 nt, synthetic construct; identical to SEQ ID NO: 30937
  source 1..118: mol_type = other RNA

SEQ ID NO: 37531 - RNA, 116 nt, synthetic construct; identical to SEQ ID NO: 30938
  source 1..116: mol_type = other RNA

SEQ ID NO: 37532 - RNA, 116 nt, synthetic construct; identical to SEQ ID NO: 30939
  source 1..116: mol_type = other RNA

SEQ ID NO: 37533 - RNA, 116 nt, synthetic construct; identical to SEQ ID NO: 30940
  source 1..116: mol_type = other RNA

SEQ ID NO: 37534 - RNA, 116 nt, synthetic construct; identical to SEQ ID NO: 30941
  source 1..116: mol_type = other RNA

SEQ ID NO: 37535 - RNA, 116 nt, synthetic construct; identical to SEQ ID NO: 30942
  source 1..116: mol_type = other RNA

SEQ ID NO: 37536 - RNA, 116 nt, synthetic construct; identical to SEQ ID NO: 30943
  source 1..116: mol_type = other RNA

SEQ ID NO: 37537 - RNA, 127 nt, synthetic construct; identical to SEQ ID NO: 30944
  source 1..127: mol_type = other RNA

SEQ ID NO: 37538 - RNA, 127 nt, synthetic construct; identical to SEQ ID NO: 30945
  source 1..127: mol_type = other RNA

SEQ ID NO: 37539 - RNA, 127 nt, synthetic construct; identical to SEQ ID NO: 30946
  source 1..127: mol_type = other RNA

SEQ ID NO: 37540 - RNA, 127 nt, synthetic construct; identical to SEQ ID NO: 30947
  source 1..127: mol_type = other RNA

SEQ ID NO: 37541 - RNA, 127 nt, synthetic construct; identical to SEQ ID NO: 30948
  source 1..127: mol_type = other RNA

SEQ ID NO: 37542 - RNA, 127 nt, synthetic construct; identical to SEQ ID NO: 30949
  source 1..127: mol_type = other RNA

SEQ ID NO: 37543 - RNA, 125 nt, synthetic construct; identical to SEQ ID NO: 30950
  source 1..125: mol_type = other RNA

SEQ ID NO: 37544 - RNA, 125 nt, synthetic construct; identical to SEQ ID NO: 30951
  source 1..125: mol_type = other RNA

SEQ ID NO: 37545 - RNA, 125 nt, synthetic construct; identical to SEQ ID NO: 30952
  source 1..125: mol_type = other RNA

SEQ ID NO: 37546 - RNA, 125 nt, synthetic construct; identical to SEQ ID NO: 30953
  source 1..125: mol_type = other RNA

SEQ ID NO: 37547 - RNA, 125 nt, synthetic construct; identical to SEQ ID NO: 30954
  source 1..125: mol_type = other RNA

SEQ ID NO: 37548 - RNA, 125 nt, synthetic construct; identical to SEQ ID NO: 30955
  source 1..125: mol_type = other RNA

SEQ ID NO: 37549 - RNA, 123 nt, synthetic construct; identical to SEQ ID NO: 30956
  source 1..123: mol_type = other RNA

SEQ ID NO: 37550 - RNA, 123 nt, synthetic construct; identical to SEQ ID NO: 30957
  source 1..123: mol_type = other RNA

SEQ ID NO: 37551 - RNA, 123 nt, synthetic construct; identical to SEQ ID NO: 30958
  source 1..123: mol_type = other RNA

SEQ ID NO: 37552 - RNA, 123 nt, synthetic construct; identical to SEQ ID NO: 30959
  source 1..123: mol_type = other RNA

SEQ ID NO: 37553 - RNA, 123 nt, synthetic construct; identical to SEQ ID NO: 30960
  source 1..123: mol_type = other RNA

SEQ ID NO: 37554 - RNA, 123 nt, synthetic construct; identical to SEQ ID NO: 30961
  source 1..123: mol_type = other RNA

SEQ ID NO: 37555 - RNA, 121 nt, synthetic construct; identical to SEQ ID NO: 30962
  source 1..121: mol_type = other RNA

SEQ ID NO: 37556 - RNA, 121 nt, synthetic construct; identical to SEQ ID NO: 30963
  source 1..121: mol_type = other RNA

SEQ ID NO: 37557 - RNA, 121 nt, synthetic construct; identical to SEQ ID NO: 30964
  source 1..121: mol_type = other RNA

SEQ ID NO: 37558 - RNA, 121 nt, synthetic construct; identical to SEQ ID NO: 30965
  source 1..121: mol_type = other RNA

SEQ ID NO: 37559 - RNA, 121 nt, synthetic construct; identical to SEQ ID NO: 30966
  source 1..121: mol_type = other RNA

SEQ ID NO: 37560 - RNA, 121 nt, synthetic construct; identical to SEQ ID NO: 30967
  source 1..121: mol_type = other RNA

SEQ ID NO: 37561 - RNA, 119 nt, synthetic construct; identical to SEQ ID NO: 30968
  source 1..119: mol_type = other RNA

SEQ ID NO: 37562 - RNA, 119 nt, synthetic construct; identical to SEQ ID NO: 30969
  source 1..119: mol_type = other RNA

SEQ ID NO: 37563 - RNA, 119 nt, synthetic construct; identical to SEQ ID NO: 30970
  source 1..119: mol_type = other RNA

SEQ ID NO: 37564 - RNA, 119 nt, synthetic construct; identical to SEQ ID NO: 30971
  source 1..119: mol_type = other RNA

SEQ ID NO: 37565 - RNA, 119 nt, synthetic construct; identical to SEQ ID NO: 30972
  source 1..119: mol_type = other RNA

SEQ ID NO: 37566 - RNA, 119 nt, synthetic construct; identical to SEQ ID NO: 30973
  source 1..119: mol_type = other RNA

SEQ ID NO: 37567 - RNA, 126 nt, synthetic construct; identical to SEQ ID NO: 30974
  source 1..126: mol_type = other RNA

SEQ ID NO: 37568 - RNA, 126 nt, synthetic construct; identical to SEQ ID NO: 30975
  source 1..126: mol_type = other RNA

SEQ ID NO: 37569 - RNA, 126 nt, synthetic construct; identical to SEQ ID NO: 30976
  source 1..126: mol_type = other RNA

SEQ ID NO: 37570 - RNA, 126 nt, synthetic construct; identical to SEQ ID NO: 30977
  source 1..126: mol_type = other RNA

SEQ ID NO: 37571 - RNA, 126 nt, synthetic construct; identical to SEQ ID NO: 30978
  source 1..126: mol_type = other RNA

SEQ ID NO: 37572 - RNA, 126 nt, synthetic construct; identical to SEQ ID NO: 30979
  source 1..126: mol_type = other RNA

SEQ ID NO: 37573 - RNA, 124 nt, synthetic construct; identical to SEQ ID NO: 30980
  source 1..124: mol_type = other RNA

SEQ ID NO: 37574 - RNA, 124 nt, synthetic construct; identical to SEQ ID NO: 30981
  source 1..124: mol_type = other RNA

SEQ ID NO: 37575 - RNA, 124 nt, synthetic construct; identical to SEQ ID NO: 30982
  source 1..124: mol_type = other RNA

SEQ ID NO: 37576 - RNA, 124 nt, synthetic construct; identical to SEQ ID NO: 30983
  source 1..124: mol_type = other RNA

SEQ ID NO: 37577 - RNA, 124 nt, synthetic construct; identical to SEQ ID NO: 30984
  source 1..124: mol_type = other RNA

SEQ ID NO: 37578 - RNA, 124 nt, synthetic construct; identical to SEQ ID NO: 30985
  source 1..124: mol_type = other RNA

SEQ ID NO: 37579 - RNA, 122 nt, synthetic construct; identical to SEQ ID NO: 30986
  source 1..122: mol_type = other RNA

SEQ ID NO: 37580 - RNA, 122 nt, synthetic construct; identical to SEQ ID NO: 30987
  source 1..122: mol_type = other RNA

SEQ ID NO: 37581 - RNA, 122 nt, synthetic construct; identical to SEQ ID NO: 30988
  source 1..122: mol_type = other RNA

SEQ ID NO: 37582 - RNA, 122 nt, synthetic construct; identical to SEQ ID NO: 30989
  source 1..122: mol_type = other RNA

SEQ ID NO: 37583 - RNA, 122 nt, synthetic construct; identical to SEQ ID NO: 30990
  source 1..122: mol_type = other RNA

SEQ ID NO: 37584 - RNA, 122 nt, synthetic construct; identical to SEQ ID NO: 30991
  source 1..122: mol_type = other RNA

SEQ ID NO: 37585 - RNA, 120 nt, synthetic construct; identical to SEQ ID NO: 30992
  source 1..120: mol_type = other RNA

SEQ ID NO: 37586 - RNA, 120 nt, synthetic construct; identical to SEQ ID NO: 30993
  source 1..120: mol_type = other RNA

SEQ ID NO: 37587 - RNA, 120 nt, synthetic construct; identical to SEQ ID NO: 30994
  source 1..120: mol_type = other RNA

SEQ ID NO: 37588 - RNA, 120 nt, synthetic construct; identical to SEQ ID NO: 30995
  source 1..120: mol_type = other RNA

SEQ ID NO: 37589 - RNA, 120 nt, synthetic construct; identical to SEQ ID NO: 30996
  source 1..120: mol_type = other RNA

SEQ ID NO: 37590 - RNA, 120 nt, synthetic construct; identical to SEQ ID NO: 30997
  source 1..120: mol_type = other RNA

SEQ ID NO: 37591 - RNA, 118 nt, synthetic construct; identical to SEQ ID NO: 30998
  source 1..118: mol_type = other RNA

SEQ ID NO: 37592 - RNA, 118 nt, synthetic construct; identical to SEQ ID NO: 30999
  source 1..118: mol_type = other RNA

SEQ ID NO: 37593 - RNA, 118 nt, synthetic construct; identical to SEQ ID NO: 31000
  source 1..118: mol_type = other RNA

SEQ ID NO: 37594 - RNA, 118 nt, synthetic construct; identical to SEQ ID NO: 31001
  source 1..118: mol_type = other RNA

SEQ ID NO: 37595 - RNA, 118 nt, synthetic construct; identical to SEQ ID NO: 31002
  source 1..118: mol_type = other RNA

SEQ ID NO: 37596 - RNA, 118 nt, synthetic construct; identical to SEQ ID NO: 31003
  source 1..118: mol_type = other RNA

SEQ ID NO: 37597 - RNA, 125 nt, synthetic construct; identical to SEQ ID NO: 31004
  source 1..125: mol_type = other RNA

SEQ ID NO: 37598 - RNA, 125 nt, synthetic construct; identical to SEQ ID NO: 31005
  source 1..125: mol_type = other RNA

SEQ ID NO: 37599 - RNA, 125 nt, synthetic construct; identical to SEQ ID NO: 31006
  source 1..125: mol_type = other RNA

SEQ ID NO: 37600 - RNA, 125 nt, synthetic construct; identical to SEQ ID NO: 31007
  source 1..125: mol_type = other RNA

SEQ ID NO: 37601 - RNA, 125 nt, synthetic construct; identical to SEQ ID NO: 31008
  source 1..125: mol_type = other RNA

SEQ ID NO: 37602 - RNA, 125 nt, synthetic construct; identical to SEQ ID NO: 31009
  source 1..125: mol_type = other RNA

SEQ ID NO: 37603 - RNA, 123 nt, synthetic construct; identical to SEQ ID NO: 31010
  source 1..123: mol_type = other RNA

SEQ ID NO: 37604 - RNA, 123 nt, synthetic construct; identical to SEQ ID NO: 31011
  source 1..123: mol_type = other RNA

SEQ ID NO: 37605 - RNA, 123 nt, synthetic construct; identical to SEQ ID NO: 31012
  source 1..123: mol_type = other RNA

SEQ ID NO: 37606 - RNA, 123 nt, synthetic construct; identical to SEQ ID NO: 31013
  source 1..123: mol_type = other RNA

SEQ ID NO: 37607 - RNA, 123 nt, synthetic construct; identical to SEQ ID NO: 31014
  source 1..123: mol_type = other RNA

SEQ ID NO: 37608 - RNA, 123 nt, synthetic construct; identical to SEQ ID NO: 31015
  source 1..123: mol_type = other RNA

SEQ ID NO: 37609 - RNA, 121 nt, synthetic construct; identical to SEQ ID NO: 31016
  source 1..121: mol_type = other RNA

SEQ ID NO: 37610 - RNA, 121 nt, synthetic construct; identical to SEQ ID NO: 31017
  source 1..121: mol_type = other RNA

SEQ ID NO: 37611 - RNA, 121 nt, synthetic construct; identical to SEQ ID NO: 31018
  source 1..121: mol_type = other RNA

SEQ ID NO: 37612 - RNA, 121 nt, synthetic construct; identical to SEQ ID NO: 31019
  source 1..121: mol_type = other RNA

SEQ ID NO: 37613 - RNA, 121 nt, synthetic construct; identical to SEQ ID NO: 31020
  source 1..121: mol_type = other RNA

SEQ ID NO: 37614 - RNA, 121 nt, synthetic construct; identical to SEQ ID NO: 31021
  source 1..121: mol_type = other RNA

SEQ ID NO: 37615 - RNA, 119 nt, synthetic construct; identical to SEQ ID NO: 31022
  source 1..119: mol_type = other RNA

SEQ ID NO: 37616 - RNA, 119 nt, synthetic construct; identical to SEQ ID NO: 31023
  source 1..119: mol_type = other RNA

SEQ ID NO: 37617 - RNA, 119 nt, synthetic construct; identical to SEQ ID NO: 31024
  source 1..119: mol_type = other RNA

SEQ ID NO: 37618 - RNA, 119 nt, synthetic construct; identical to SEQ ID NO: 31025
  source 1..119: mol_type = other RNA

SEQ ID NO: 37619 - RNA, 119 nt, synthetic construct; identical to SEQ ID NO: 31026
  source 1..119: mol_type = other RNA

SEQ ID NO: 37620 - RNA, 119 nt, synthetic construct; identical to SEQ ID NO: 31027
  source 1..119: mol_type = other RNA

SEQ ID NO: 37621 - RNA, 117 nt, synthetic construct; identical to SEQ ID NO: 31028
  source 1..117: mol_type = other RNA

SEQ ID NO: 37622 - RNA, 117 nt, synthetic construct; identical to SEQ ID NO: 31029
  source 1..117: mol_type = other RNA

SEQ ID NO: 37623 - RNA, 117 nt, synthetic construct; identical to SEQ ID NO: 31030
  source 1..117: mol_type = other RNA

SEQ ID NO: 37624 - RNA, 117 nt, synthetic construct; identical to SEQ ID NO: 31031
  source 1..117: mol_type = other RNA

SEQ ID NO: 37625 - RNA, 117 nt, synthetic construct; identical to SEQ ID NO: 31032
  source 1..117: mol_type = other RNA

SEQ ID NO: 37626 - RNA, 117 nt, synthetic construct; identical to SEQ ID NO: 31033
  source 1..117: mol_type = other RNA

SEQ ID NO: 37627 - DNA, 76 bp, synthetic construct; identical to SEQ ID NO: 11012
  source 1..76: mol_type = other DNA

SEQ ID NO: 37628-37632 - skipped (5 entries)

SEQ ID NO: 37633 - DNA, 17 bp, synthetic construct
  source 1..17: mol_type = other DNA
tattgtggcagcaaagt

SEQ ID NO: 37634 - protein, 5 aa, unidentified
IESRP

SEQ ID NO: 37635 - protein, 4 aa, unidentified
YADD

SEQ ID NO: 37636 - protein, 4 aa, unidentified
YMDD

SEQ ID NO: 37637 - protein, 4 aa, unidentified
YVDD

SEQ ID NO: 37638 - protein, 9 aa, unidentified
LAGLIDADG

SEQ ID NO: 37639 - protein, 6 aa, unidentified
IENSSP

SEQ ID NO: 37640 - RNA, 100 nt, synthetic construct
  source 1..100: mol_type = other RNA
  misc_difference 1..100: note = This sequence may encompass 5, 10, 20, 30, 50, 70, 100 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 37641 - RNA, 20 nt, synthetic construct
  source 1..20: mol_type = other RNA
acacaaataccagtccagcg

SEQ ID NO: 37642 - protein, 4 aa, synthetic construct
IPRP

SEQ ID NO: 37643 - DNA, 16 bp, synthetic construct
  source 1..16: mol_type = other DNA
ataccttggcccttct

SEQ ID NO: 37644 - DNA, 16 bp, synthetic construct
  source 1..16: mol_type = other DNA
atacctcggcccttct

SEQ ID NO: 37645 - DNA, 16 bp, synthetic construct
  source 1..16: mol_type = other DNA
ataccgcggcccttct

SEQ ID NO: 37646 - DNA, 16 bp, synthetic construct
  source 1..16: mol_type = other DNA
atccctcggcccttct

SEQ ID NO: 37647 - DNA, 16 bp, synthetic construct
  source 1..16: mol_type = other DNA
atacctcgccccttct

SEQ ID NO: 37648 - DNA, 16 bp, synthetic construct
  source 1..16: mol_type = other DNA
ataccgcgccccttct

SEQ ID NO: 37649 - DNA, 16 bp, synthetic construct
  source 1..16: mol_type = other DNA
ataccgcgcccattct

SEQ ID NO: 37650 - protein, 4 aa, synthetic construct
PRPF

SEQ ID NO: 37651 - DNA, 12 bp, synthetic construct
  source 1..12: mol_type = other DNA
ccttggcccttc

SEQ ID NO: 37652 - DNA, 12 bp, synthetic construct
  source 1..12: mol_type = other DNA
cctcggcccttc

SEQ ID NO: 37653 - DNA, 12 bp, synthetic construct
  source 1..12: mol_type = other DNA
ccgcggcccttc

SEQ ID NO: 37654 - DNA, 12 bp, synthetic construct
  source 1..12: mol_type = other DNA
cctcgccccttc

SEQ ID NO: 37655 - DNA, 12 bp, synthetic construct
  source 1..12: mol_type = other DNA
cctcgcccattc

SEQ ID NO: 37656 - DNA, 12 bp, synthetic construct
  source 1..12: mol_type = other DNA
ccgcgccccttc

SEQ ID NO: 37657 - DNA, 12 bp, synthetic construct
  source 1..12: mol_type = other DNA
ccgcgcccattc

SEQ ID NO: 37658 - protein, 4 aa, synthetic construct
TIPR

SEQ ID NO: 37659 - DNA, 12 bp, synthetic construct
  source 1..12: mol_type = other DNA
acaataccttgg

SEQ ID NO: 37660 - DNA, 12 bp, synthetic construct
  source 1..12: mol_type = other DNA
acaatacctcgg

SEQ ID NO: 37661 - DNA, 12 bp, synthetic construct
  source 1..12: mol_type = other DNA
acaataccgcgg

SEQ ID NO: 37662 - DNA, 12 bp, synthetic construct
  source 1..12: mol_type = other DNA
acaatccctcgg

SEQ ID NO: 37663 - DNA, 12 bp, synthetic construct
  source 1..12: mol_type = other DNA
acaatcccgcgg

SEQ ID NO: 37664 - DNA, 12 bp, synthetic construct
  source 1..12: mol_type = other DNA
acaatacctcgc

SEQ ID NO: 37665 - DNA, 12 bp, synthetic construct
  source 1..12: mol_type = other DNA
acgatacctcgg
